US012642840B2

(12) United States Patent
Babcock et al.

(10) Patent No.: US 12,642,840 B2
(45) Date of Patent: Jun. 2, 2026

(54) METHODS OF USING INTERLEUKIN-2 AGENTS

(71) Applicants: VISTERRA, INC., Waltham, MA (US); THE CHILDREN'S HOSPITAL OF PHILADELPHIA, Philadelphia, PA (US)

(72) Inventors: Gregory Babcock, Marlborough, MA (US); Wayne Hancock, Philadelphia, PA (US)

(73) Assignees: Visterra, Inc., Waltham, MA (US); The Children's Hospital of Philadelphia, Philadelphia, PA (US)

( * ) Notice: Subject to any disclaimer, the term of this patent is extended or adjusted under 35 U.S.C. 154(b) by 200 days.

(21) Appl. No.: 18/060,725

(22) Filed: Dec. 1, 2022

(65) Prior Publication Data

US 2024/0041981 A1 Feb. 8, 2024

Related U.S. Application Data

(60) Provisional application No. 63/348,201, filed on Jun. 2, 2022, provisional application No. 63/284,978, filed on Dec. 1, 2021.

(51) Int. Cl.
*A61K 38/20* (2006.01)
*A61K 31/436* (2006.01)
*A61P 37/06* (2006.01)

(52) U.S. Cl.
CPC ........ *A61K 38/2013* (2013.01); *A61K 31/436* (2013.01); *A61P 37/06* (2018.01)

(58) Field of Classification Search
CPC ... A61K 38/2013; A61K 31/436; A61P 37/06; A61P 37/00
See application file for complete search history.

(56) References Cited

U.S. PATENT DOCUMENTS

| | | | |
|---|---|---|---|
| 4,908,433 A | 3/1990 | Mertelsmann et al. | |
| 5,466,447 A | 11/1995 | Abels et al. | |
| 5,525,491 A | 6/1996 | Huston et al. | |
| 6,955,807 B1 * | 10/2005 | Shanafelt | C07K 14/55 |
| | | | 435/71.1 |
| 7,569,215 B2 | 8/2009 | Wittrup et al. | |
| 7,951,360 B2 | 5/2011 | Wittrup et al. | |
| 8,349,311 B2 | 1/2013 | Wittrup et al. | |
| 9,266,938 B2 | 2/2016 | Ast et al. | |
| 9,289,493 B2 | 3/2016 | Ko | |
| 9,359,415 B2 | 6/2016 | Alvarez et al. | |
| 9,428,563 B2 | 8/2016 | Alvarez | |
| 9,447,159 B2 | 9/2016 | Ast et al. | |
| 9,546,203 B2 | 1/2017 | Kannan | |
| 9,580,486 B2 | 2/2017 | Gavin et al. | |
| 9,616,105 B2 | 4/2017 | Paulsen et al. | |
| 9,669,071 B2 | 6/2017 | Klatzmann et al. | |
| 9,732,134 B2 | 8/2017 | Gavin et al. | |

| | | |
|---|---|---|
| 9,844,582 B2 | 12/2017 | Wittrup et al. |
| 9,932,380 B2 | 4/2018 | Gavin et al. |
| 10,035,836 B1 | 7/2018 | Greve |
| 10,086,046 B2 | 10/2018 | Paulsen et al. |
| 10,093,711 B2 | 10/2018 | Kannan |
| 10,174,091 B1 | 1/2019 | Higginson-Scott et al. |
| 10,174,092 B1 | 1/2019 | Higginson-Scott et al. |
| 10,184,009 B2 | 1/2019 | Ast et al. |
| 10,293,028 B2 | 5/2019 | Klatzmann et al. |
| 10,316,104 B2 | 6/2019 | Ast et al. |
| 10,323,098 B2 | 6/2019 | Ast et al. |
| 10,407,481 B2 | 9/2019 | Alvarez |
| 10,562,949 B2 | 2/2020 | Hosse et al. |
| 10,562,950 B2 | 2/2020 | Kannan |
| 10,676,516 B2 | 6/2020 | Viney et al. |
| 10,765,723 B2 | 9/2020 | Klatzmann et al. |
| 10,829,535 B2 | 11/2020 | Gavin et al. |
| 10,851,144 B2 | 12/2020 | Butz et al. |
| 10,927,158 B2 | 2/2021 | Seidel, III et al. |
| 10,946,068 B2 | 3/2021 | Higginson-Scott et al. |
| 11,098,099 B2 | 8/2021 | Klein et al. |
| 11,117,945 B2 | 9/2021 | Seidel, III et al. |
| 11,130,822 B2 | 9/2021 | Ast et al. |
| 11,319,355 B2 | 5/2022 | Bemett et al. |
| 11,401,314 B2 | 8/2022 | Seidel, III et al. |
| 2003/0195154 A1 | 10/2003 | Walker et al. |
| 2005/0142106 A1 | 6/2005 | Wittrup et al. |

(Continued)

FOREIGN PATENT DOCUMENTS

| | | |
|---|---|---|
| AU | 2016246152 A1 | 11/2017 |
| CA | 2982362 A1 | 10/2016 |

(Continued)

OTHER PUBLICATIONS

Lazar et al. ( Mol. Cell. Biol., 8: 1247-1252, 1988 (Year: 1988).*
Bowie et al. ( Science, 1990,247: 1306-1310) (col. 1, p. 1306) (col. 2, p. 1306) (Year: 1990).*
Burgess et al. ( J. Cell Biol., 8:1247-1252, 1988) (Year: 1988).*
Bork (Genome Research, 2000, 10: 398-400) ( p. 398 , col. 1) ( p. 398, col. 2) ( p. 398 column 3) ( see legend for table 1, p. 399) ( p. 399, paragraph bridging cols. 2 and 3) (p. 400, paragraph bridging cols. 1 and 2) (Year: 2000).*
Greenspan et al. (Defining epitopes: It's not as easy as it seems; Nature Biotechnology, 17:936-937). (p. 936, 1st column) (p. 936—, 3rd column) (Year: 1999).*
Presta (Current Opinion in Immunology. 20(4):460-470. August) (Year: 2008).*
Bowie et al. Deciphering the Message in Protein Sequences: Tolerance to Amino Acid Substitutions. Science, 1990, 247:1306-1310 (Year: 1990).*

(Continued)

*Primary Examiner* — Vanessa L. Ford
*Assistant Examiner* — Sandra Carter
(74) *Attorney, Agent, or Firm* — Proskauer Rose LLP

(57) ABSTRACT

The present invention provides, among other things, methods of using IL-2 fusion proteins, comprising an IL-2 variant and an Pc region, to treat and/or prevent heart transplant rejections. Methods of treating heart disease or a symptom thereof, conditioning a subject for heart transplant, modulating immunosuppression, and selectively increasing regulatory T cells are also disclosed.

11 Claims, 8 Drawing Sheets

Specification includes a Sequence Listing.

(56)                    References Cited

U.S. PATENT DOCUMENTS

| | | | |
|---|---|---|---|
| 2006/0160187 | A1 | 7/2006 | Denis-Mize et al. |
| 2006/0234205 | A1 | 10/2006 | Cao et al. |
| 2011/0150826 | A1 | 6/2011 | Paulsen et al. |
| 2011/0274650 | A1 | 11/2011 | Gavin et al. |
| 2014/0286898 | A1 | 9/2014 | Gavin et al. |
| 2017/0081382 | A1 | 3/2017 | Kannan |
| 2017/0313753 | A1 | 11/2017 | Gavin et al. |
| 2018/0125941 | A1 | 5/2018 | Greve |
| 2018/0340014 | A1 | 11/2018 | Viney et al. |
| 2019/0077881 | A1 | 3/2019 | Ast et al. |
| 2019/0169254 | A1 | 6/2019 | Higginson-Scott et al. |
| 2019/0241638 | A1 | 8/2019 | Bernett et al. |
| 2019/0322765 | A1 | 10/2019 | Ast et al. |
| 2019/0352363 | A1 | 11/2019 | Seidel, III et al. |
| 2019/0375812 | A1 | 12/2019 | Greve |
| 2020/0040053 | A1 | 2/2020 | Alvarez |
| 2020/0172591 | A1 | 6/2020 | Hosse et al. |
| 2020/0325201 | A1 | 10/2020 | Higginson-Scott et al. |
| 2021/0024601 | A1* | 1/2021 | Carlson .................. A61P 13/12 |
| 2021/0038691 | A1 | 2/2021 | Klatzmann et al. |
| 2021/0047382 | A1 | 2/2021 | Greve |
| 2021/0070828 | A1 | 3/2021 | Greve |
| 2021/0094996 | A1 | 4/2021 | Viney et al. |
| 2021/0094997 | A1 | 4/2021 | Gavin et al. |
| 2021/0107962 | A1 | 4/2021 | Seidel, III et al. |
| 2021/0139554 | A1 | 5/2021 | Butz et al. |
| 2021/0277085 | A1 | 9/2021 | Higginson-Scott et al. |
| 2022/0033456 | A1 | 2/2022 | Seidel, III et al. |
| 2022/0177535 | A1 | 6/2022 | Carlson et al. |
| 2022/0226441 | A1 | 7/2022 | Tavernier et al. |
| 2022/0226442 | A1 | 7/2022 | Carlson et al. |
| 2023/0390360 | A1 | 12/2023 | Schachter et al. |

FOREIGN PATENT DOCUMENTS

| | | | |
|---|---|---|---|
| CN | 105143253 | A | 12/2015 |
| CN | 109071623 | A | 12/2018 |
| CN | 111432831 | A | 7/2020 |
| EA | 025851 | B1 | 2/2017 |
| EP | 0262802 | A2 | 4/1988 |
| EP | 0573551 | B1 | 5/2003 |
| EP | 2288372 1 | A2 | 3/2011 |
| EP | 2673294 | B1 | 4/2016 |
| EP | 2640411 | B1 | 12/2017 |
| EP | 3280725 | A2 | 2/2018 |
| EP | 2859015 | B1 | 3/2018 |
| EP | 2882458 | B1 | 7/2018 |
| EP | 2683395 | B1 | 8/2018 |
| EP | 3075745 | B1 | 9/2018 |
| EP | 2702074 | B1 | 11/2018 |
| EP | 3102595 | B1 | 11/2018 |
| EP | 3180020 | B1 | 12/2018 |
| EP | 2970441 | B1 | 3/2019 |
| EP | 2970423 | B1 | 4/2019 |
| EP | 3489255 | A1 | 5/2019 |
| EP | 3587444 | A1 | 1/2020 |
| EP | 3630163 | A1 | 4/2020 |
| EP | 3443979 | B1 | 5/2020 |
| EP | 3482766 | B1 | 5/2020 |
| EP | 2382228 | B1 | 8/2020 |
| EP | 3766513 | A1 | 1/2021 |
| JP | 5651583 | B2 | 1/2015 |
| JP | 5766124 | B2 | 8/2015 |
| JP | 5878182 | B2 | 3/2016 |
| JP | 2016514161 | A | 5/2016 |
| JP | 2016518823 | A | 6/2016 |
| JP | 5972355 | B2 | 8/2016 |
| JP | 6054889 | B2 | 12/2016 |
| JP | 6155300 | B2 | 6/2017 |
| JP | 6306201 | B2 | 4/2018 |
| JP | 2018512151 | A | 5/2018 |
| JP | 6416855 | B2 | 10/2018 |
| JP | 6450365 | B2 | 1/2019 |
| JP | 6480409 | B2 | 3/2019 |
| JP | 6526561 | B2 | 6/2019 |

| | | | |
|---|---|---|---|
| JP | 6559607 | B2 | 8/2019 |
| JP | 6640834 | B2 | 2/2020 |
| JP | 2020511949 | A | 4/2020 |
| JP | 6768633 | B2 | 10/2020 |
| JP | 2021006038 | A | 1/2021 |
| JP | 2022541657 | A | 9/2022 |
| KR | 20150130342 | A | 11/2015 |
| KR | 20180133198 | A | 12/2018 |
| RU | 2235729 | C2 | 9/2004 |
| SG | 11201708349 | | 11/2017 |
| TW | 202118774 | A | 5/2021 |
| WO | 1988009344 | A1 | 12/1988 |
| WO | 1992015682 | A1 | 9/1992 |
| WO | 199320849 | A1 | 10/1993 |
| WO | 1995011922 | A1 | 5/1995 |
| WO | 199960128 | A1 | 11/1999 |
| WO | 2003015697 | A2 | 2/2003 |
| WO | 2005007121 | A2 | 1/2005 |
| WO | 2005086751 | A2 | 9/2005 |
| WO | 2005086798 | A2 | 9/2005 |
| WO | 2008003473 | A2 | 1/2008 |
| WO | 2009061853 | A2 | 5/2009 |
| WO | 2009135615 | A2 | 11/2009 |
| WO | 2010021519 | A2 | 2/2010 |
| WO | 2010021520 | A2 | 2/2010 |
| WO | 2010021521 | A2 | 2/2010 |
| WO | 2010021522 | A2 | 2/2010 |
| WO | 2010021523 | A2 | 2/2010 |
| WO | 2010021524 | A2 | 2/2010 |
| WO | 2010021525 | A2 | 2/2010 |
| WO | 2010021526 | A2 | 2/2010 |
| WO | 2010021527 | A2 | 2/2010 |
| WO | 2010085495 | A1 | 7/2010 |
| WO | 2012065212 | A1 | 5/2012 |
| WO | 2012107417 | A1 | 8/2012 |
| WO | 2012123381 | A1 | 9/2012 |
| WO | 2012146628 | A1 | 11/2012 |
| WO | 2013177187 | A2 | 11/2013 |
| WO | 2013184938 | A2 | 12/2013 |
| WO | 2013184939 | A2 | 12/2013 |
| WO | 2013184942 | A1 | 12/2013 |
| WO | 2014023752 | A1 | 2/2014 |
| WO | 2014153063 | A1 | 9/2014 |
| WO | 2014153111 | A2 | 9/2014 |
| WO | 2015118016 | A1 | 8/2015 |
| WO | 2016014428 | A2 | 1/2016 |
| WO | 2016025385 | A1 | 2/2016 |
| WO | 2016164937 | A2 | 10/2016 |
| WO | 2017014679 | A2 | 1/2017 |
| WO | 2016164937 | A9 | 5/2018 |
| WO | 2018089420 | A1 | 5/2018 |
| WO | 2018119114 | A1 | 6/2018 |
| WO | 2018217989 | A1 | 11/2018 |
| WO | 2019010224 | A1 | 1/2019 |
| WO | 2019070726 | A1 | 4/2019 |
| WO | 2019112852 | A1 | 6/2019 |
| WO | 2019112854 | A1 | 6/2019 |
| WO | 2019125732 | A1 | 6/2019 |
| WO | 2020020783 | A1 | 1/2020 |
| WO | 2021021606 | A1 | 2/2021 |
| WO | 2022120224 | A1 | 6/2022 |
| WO | 2022159590 | A1 | 7/2022 |
| WO | 2023102463 | A1 | 6/2023 |
| WO | 2023154870 | A1 | 8/2023 |

OTHER PUBLICATIONS

Burgess et al. Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue. J. Cell Biol. 111:2129-2138, 1990 (Year: 1990).*

Lazar et al. Transforming Growth Factor alpha: Mutation of Aspartic Acid 47 and Leucine 48 Results in Different Biological Activities. Mol. Cell. Biol., 8:1247-1252, 1988 (Year: 1988).*

Bork. Powers and Pitfalls in Sequence Analysis: The 70% Hurdle. Genome Research, 2000; 10:398-400 (Year: 2000).*

(56)          References Cited

OTHER PUBLICATIONS

Malhotra, P. (Jun. 11, 2023). Immunology of transplant rejection. Immunology of Transplant Rejection. https://emedicine.medscape.com/article/432209-overview#a2 (Year: 2023).*

Zheng et al. The balance of deletion and regulation in allograft tolerance. Immunol Rev. Dec. 2003:196:75-84 (Year: 2003).*

Tonsho et al. Heart Transplantation: Challenges Facing the Field. Cold Spring Harb Perspect Med 2014;4:a015636 (Year: 2014).*

Millington et al. Effects of an agonist interleukin-2/Fc fusion protein, a mutant antagonist interleukin-15/Fc fusion protein, and sirolimus on cardiac allograft survival in non-human primates. Heart Lung Transplant. Apr. 2012;31(4):427-35 (Year: 2012).*

Mayo Foundation for Medical Education and Research. (Aug. 13, 2024). Heart disease. Mayo Clinic. https://www.mayoclinic.org/diseases-conditions/heart-disease/symptoms-causes/syc-20353118 (Year: 2024).*

Feenstra et al. Drug-induced heart failure. J Am Coll Cardiol 1999;33:1152-62 (Year: 1999).*

Adams et al., "Targeting cytokines to inflammation sites", Nature Biotechnology (2003), vol. 21, pp. 1314-1320.

Adeegbe et al., "Cutting Edge: Allogeneic CD4+CD25+Foxp3+ T Regulatory Cells Suppress Autoimmunity while Establishing Transplantation Tolerance", J. Immunol. (2006), vol. 176, pp. 7149-7153.

Ahmadzadeh et al., "IL-2 administration increases CD4 CD25hi Foxp3 regulatory T cells in cancer patients", Blood (2006), vol. 107, No. 6, pp. 2409-2414.

Allan et al., "Activation-induced FOXP3 in human T effector cells does not suppress proliferation or cytokine production", International Immunoloav (2007), vol. 19, No. 4, pp. 345-354.

Arai et al., "Design of the linkers which effectively separate domains of a bifunctional fusion protein", Protein Eng. (2001), vol. 14, No. 8, pp. 529-532.

Argos, P. "An investigation of oligopeptides linking domains in protein tertiary structures and possible candidates for general gene fusion," Journal of Molecular Biology, vol. 211, No. 4 (1990) pp. 943-958.

Bachmann, M. F. & Oxenius, A. "Interleukin 2: from immunostimulation to immunoregulation and back again," EMBO Reports, vol. 8, No. 12 (2007) pp. 1142-1148.

Bell et al., "Sustained in vivo signaling by long-lived IL-2 induces prolonged increases of regulatory T cells", .J Autoimmun. (2015), vol. 56, pp. 66-80.

Bensinger et al., "Distinct IL-2 Receptor Signaling Pattern in CD4 +CD25+ Regulatory T Cells", J Immunol (2009), vol. 172, No. 9, pp. 5287-5296.

Boyman et al., "Potential use of IL-2/anti-IL-2 antibody immune complexes for the treatment of cancer and autoimmune disease", Expert Opin. Biol. Ther. (2006), vol. 6, No. 12, pp. 1325-1331.

Brusko et al., "Human regulatory T cells: role in autoimmune disease and therapeutic opportunities" Immunological Reviews (2008), vol. 223, pp. 371-390.

Carmenate et al., "Human IL-2 mutein with higher antitumor efficacy than wild type IL-2", J Immunol. (2013), vol. 190, No. 12, pp. 6230-6238.

Cassell et al., "Therapeutic Enhancement of IL-2 Through Molecular Design", Current Pharmaceutical Design (2002), vol. 8, pp. 2171-2183.

Chen & Hershey, "Signal transducer and activator of transcription signals in allergic disease", Journal of Allergy and Clinical Immunology (2007), vol. 119, No. 3, pp. 529-541.

Eisenstein & Williams, "The Treg/Th17 Cell Balance: A New Paradigm for Autoimmunity", Pediatr Res. (2009), vol. 65, No. 2, pp. 26R-31R.

Farhat, A. M. et al. "Modeling cell-specific dynamics and regulation of the common gamma chain cytokines," Cell Reports, vol. 35, No. 4 (2021): 109044.

Fujii et al., "Activation of Stat5 by interleukin 2 requires a carboxyl-terminal region of the interleukin 2 receptor beta chain but is not essential for the proliferative signal transmission," PNAS (1995), vol. 92, pp. 5482 5486.

Goodson & Katre, "Site-Directed Pegylation of Recombinant Interleukin-2 at its Glycosylation Site", Nature Biotechnology (1990), vol. 8, pp. 343-346.

Heaton et al., "Characterization of Lymphokine-Activated Killing by Human Peripheral Blood Mononuclear Cells Stimulated with Interleukin 2 (IL-2) Analogs Specific for the Intermediate Affinity IL-2 Receptor", Cellular Immunology (1993), vol. 147, No. 1, pp. 167-179.

Hoyer et al., "Interleukin-2 in the development and control of inflammatory disease", Immunological Reviews (2008), vol. 226, pp. 19-28.

Humrich et al., "Homeostatic imbalance of regulatory and effector T cells due to IL-2 depirvation amplifies murine lupus", Proc Natl Acad Sci USA (2010), vol. 107, No. 1, pp. 204-209.

Huston, J. S. et al. "Protein engineering of antibody binding sites: recovery of specific activity in an anti-digoxin single-chain Fv analogue produced in *Escherichia coli*," Proceedings of the National Academy of Sciences of the United States of America, vol. 85, No. 16 (1988) pp. 5879-5883.

Imamichi et al., "IL-15 acts as a potent inducer of CD4+CD25hi cells expressing FOXP3", Eur. J. Immunol (2008), vol. 38, No. 6, pp. 1621-1630.

International Search Report and Written Opinion in International Patent Application No. PCT/US2020/043416 dated Dec. 18, 2020.

International Search Report and Written Opinion in International Patent Application No. PCT/US2021/061883 dated Apr. 7, 2022.

International Search Report and Written Opinion in International Patent Application No. PCT/US2022/013141 dated Jun. 3, 2022.

International Search Report and Written Opinion in International Patent Application No. PCT/US2022/080728 dated Mar. 22, 2023.

International Search Report and Written Opinion in International Patent Application No. PCT/US2023/062395 dated May 26, 2023.

Jazayeri & Carroll, "Fc-Based Cytokines", BioDrugs (2008), vol. 22, pp. 11-26.

Jiang (Ed.), "Regulatory Cells and Clinical Application", Springer (2008), excerpt (pp. 17, 19, 20, 29,43, 58, 70, 77-78, 30, 94, 97, 135-136, and 261).

Koreth, J. et al. "Interleukin-2 and regulatory T cells in graft-versus-host disease," The New England Journal of Medicine, Massachusetts Medical Society, vol. 365, No. 22, (2011): pp. 2055-2066.

Lan et al., "The regulatory, inflammatory, and T cell programming roles of interleukin-2 (IL-2)", Journal of Autoimmunity (2008), vol. 31, No. 1, pp. 7-12.

Leipe et al., "Regulatory T cells in rheumatoid arthritis", Arthritis Res Ther. (2005), vol. 7, No. 3, pp. 93-99.

Letourneau et al., "IL-2- and CD25-dependent immunoregulatory mechanisms in the homeostasis of T-cell subsets", Journal of Allergy and Clinical Immunology (2009), vol. 123, No. 4, pp. 758-762.

Liston et al., "Tracing the action of IL-2 in tolerance to islet-specific antigen," Immunology and Cell Biology (2007), vol. 85, pp. 338-342.

Liu et al. "Engineered Interleukin-2 Antagonists for the Inhibition of Regulatory T cells", J. Immunother. (2009), vol. 32, No. 9, pp. 887-894.

Liu et al., "Fc Engineering for Developing Therapeutic Bispecific Antibodies and Novel Scaffolds", Front Immunol. (2017), vol. 8, pp. 38.

Malek et al., "Tolerance, not immunity, crucially depends on IL-2", Nature Reviews Immunology (2004), vol. 4, pp. 665-674.

Malek, "The Biology of Interleukin-2", Annual Review of Immunology (2008), vol. 26, pp. 453-479.

Pandiyan et al., "CD4+CD25+Foxp3+ regulatory T cells induce cytokine deprivation-mediated apoptosis of effector CD4+ T cells", Nature Immunology (2007), vol. 8, pp. 1353-1362.

Passerini et al. "STAT5-signaling cytokines regulate the expression of FOXP3 in CD41CD251 regulatory T cells and CD41CD252 effector T cells", International Immunology (2008), vol. 20, No. 3, pp. 421-443.

Peterson et al., "A long-lived IL-2 mutein that selectively activates and expands regulatory T cells as a therapy for autoimmune disease", J Autoimmun. (2018) , vol. 95, pp. 1-14.

(56) References Cited

OTHER PUBLICATIONS

Pilat, N. et al. "Treg-mediated prolonged survival of skin allografts without immunosuppression," Proceedings of the National Academy of Sciences—PNAS, vol. 116, No. 27 (2019) pp. 13508-13516.

Ram, R. & Storb, R. "Pharmacologic prophylaxis regimens for acute GVHD—past, present and future." Leukemia & Lymphoma vol. 54,8 (2013): 1591-1601.

Rao et al., "High-affinity CD25-binding IL-2 mutants potently stimulate persistent T cell growth," Biochemistry (2005), vol. 44, No. 31, pp. 10696-701.

Rao et al., "Interleukin-2 mutants with enhanced alpha-receptor subunit binding affinity", Protein Eng. (2003), vol. 16, No. 12, pp. 1081-1087.

Rojas et al., "Directed evolution of super-secreted variants from phage-displayed human Interleukin-2", Sci Rep. (2019), vol. 9, No. 1, pp. 800.

Sakaguchi et al., "Regulatory T Cells and Immune Tolerance", Cell "2008", vol. 133, No. 5, pp. 775-787.

Shanafelt et al., "A T-cell selective interleukin 2 mutein exhibits potent antitumor activity and is well tolerated in vivo," Nat Biotechnol (2000), vol. 18, pp. 1197-1202.

Shevach, "Mechanisms of Foxp3+ T Regulatory Cell-Mediated Suppression", Immunity (2009), vol. 30, No. 5, pp. 636-645.

Stauber et al., "Crystal structure of the IL-2 signaling complex: paradigm for a heterotrimeric cytokine receptor", Proc Natl Acad Sci USA (2006), vol. 103, No. 8, pp. 2788-2793.

Sun et al., "A Novel Anti-Human Syndecan-1(CD138) Monoclonal Antibody 4B3: Characterization and Application," Cellular & Molecular Immunology (2007) vol. 4, No. 3, pp. 209-214.

Tang et al., "Central Role of Defective Interleukin-2 Production in the Triggering of Islet Autoimmune Destruction", Immunity (2008), vol. 28, No. 5, pp. 687-697.

Tran et al., "Induction of FOXP3 expression in naive human CD4 FOXP3 T cells by T-cell receptor stimulation is transforming growth factor—dependent but does not confer a regulatory phenotype", Blood (2007), vol. 110, No. 8, pp. 2983-2990.

UVA Health, "Transplant Rejection", https://uvahealth.com/services/transplant/transplant-rejection, 2023.

Valencia & Lipsky, "CD4+CD25+FoxP3+ regulatory T cells in autoimmune diseases", Nature Reviews Rheumatology (2007), vol. 3, pp. 619-626.

Wang et al., "Structure of the quaternary complex of interleukin-2 with its alpha, beta, and gammac receptors", Science (2005), vol. 310, No. 5751, pp. 1159-1163.

Webster et al., "In vivo expansion of T reg cells with IL-2-mAb complexes: induction of resistance to EAE and long-term acceptance of islet allografts without immunosuppression", J. Exp. Med. (2009), vol. 206, No. 4, pp. 751-760.

Wood, K. J. "Regulatory T cells in transplantation." Transplantation Proceedings vol. 43,6 (2011): 2135-2136.

Yu, T. et al. "An Immune Based, Anti-CD138 Targeting Antibody for the Treatment of Multiple Myeloma," Blood—American Society of Hematology, (2018) vol. 132 (Supplement 1), pp. 1-3.

Zeiser et al., "Differential impact of mammalian target of rapamycin inhibition on CD4 CD25 Foxp3 regulatory T cells compared with conventional CD4 T cells", Blood (2008), vol. 11, No. 1, p. 453-462.

Zhao et al., "Increasing the homogeneity, stability and activity of human serum albumin and interferon-a2b fusion protein by linker engineering", Protein Expression and Purification (2008), vol. 61, No. 1, pp. 73-77.

Zheng, X. X. et al. "The balance of deletion and regulation in allograft tolerance." Immunological Reviews vol. 196 (2003): 75-84.

Zorn et al., "IL-2 regulates FOXP3 expression in human CD4 CD25 regulatory T cells through a STAT-dependent mechanism and induces the expansion of these cells in vivo", Blood (2006), vol. 108, No. 5, pp. 1571-1579.

Cassano, Alexandra, et al., "Tregs in transplantation tolerance: role and therapeutic potential", Frontiers in Transplantation, Aug. 30, 2023 (19 pages).

Efe, Orhan, et al., "A humanized IL-2 mutein expands Tregs and prolongs transplant survival in preclinical models", The Journal of Clinical Investigation, Mar. 1, 2024 (16 pages).

International Search Report and Written Opinion for PCT/US2021/061833 dated Feb. 17, 2022 (7 pages).

International Search Report Received for PCT/US2025/025085 dated Aug. 4, 2025 (5 pages).

Pilon, C. B., et al., "Administration of Low Doses of IL-2 Combined to Rapamycin Promotes Allogeneic Skin Graft Survival in Mice", American Journal of Transplantation, vol. 14, No. 12, Nov. 13, 2014 (pp. 2874-2882).

Ptacin, Jerod L., et al., "A CD25-biased interleukin-2 for autoimmune therapy engineered via a semi-synthetic organism", Communications Medicine, vol. 4, No. 1, Mar. 26, 2024 (16 pages).

Wang, L., et al., "Strategies for Development of Interleukin-2 Therapy in Transplant Recipients: What Works and What Doesn't", Visterra, Inc., Jun. 3, 2023, retrieved from: https://visterrainc.com/visterra_present/strategies-for-development-of-interleukin-2-therapy-in-transplant-recipients-what-works-and-what-doesnt/ (1 page).

Whitehouse, Gavin , et al., "IL-2 therapy restores regulatory T-cell dysfunction induced by calcineurin inhibitors", Proceedings of the National Academy of Sciences (PNAS), vol. 114, No. 27, Jun. 5, 2017 (pp. 7083-7088).

Borrok, M. Jack, et al., "An "Fc-Silenced" IgG1 Format With Extended Half-Life Designed for Improved Stability", Journal of Pharmaceutical Sciences, vol. 106, No. 4, Apr. 2017, pp. 1008-1017, DOI: 10.1016/j.xphs.2016.12.023 (10 pages).

Hernandez, Rosmely , et al., "Engineering IL-2 for immunotherapy of autoimmunity and cancer", Nature Reviews Immunology, vol. 22, 2022, pp. 614-628, DOI: 10.1038/s41577-022-00680-w (15 pages).

Longcan, Mei , "The correlation between signaling and allostery in type I cytokines: dynamics simulation of IL-21 receptors and prediction of allosteric regions of IL-2", China Outstanding Master's Degree Thesis, Full Text, Database of Medicine, Health Science, and Technology, vol. 01, 2021, (79 pages).

* cited by examiner

--------------With 3 ng/ml TGFβ1--------------

Beads only

Tyr-694

Total

FIG. 5

3 weeks of IL-2C &
14 d low-dose RPM
N = 5/group, H&E, x200

>110 d continued acceptance
of BALB/c cardiac allografts

Acute rejection of C3H cardiac
allografts within 8-9 d

1

METHODS OF USING INTERLEUKIN-2 AGENTS

CROSS-REFERENCE TO RELATED APPLICATIONS

This application claims the benefit of U.S. Provisional Application Nos. 63/284,978, filed Dec. 1, 2021; and 63/348,201, filed Jun. 2, 2022. The contents of the aforementioned applications are hereby incorporated by reference in their entirety.

STATEMENT AS TO FEDERALLY SPONSORED RESEARCH

This invention was made with government support under Grant No. CA253320 awarded by the National Institutes of Health. The government has certain rights in the invention.

SEQUENCE LISTING

The instant application contains a Sequence Listing which has been submitted electronically in XML file format and is hereby incorporated by reference in its entirety. Said XML copy, created on Jan. 26, 2023, is named P2029-704610_SL.xml and is 1,207,968 bytes in size.

BACKGROUND

Interleukin-2 (IL-2) is a cytokine that regulates the activities of the immune system. It is produced by leukocytes, such as T cells, natural killer (NK) cells, dendritic cells, and macrophages, in response to antigenic or mitogenic stimulation. IL-2 is important for T cell proliferation, B cell stimulation, and other activities associated with immunity and tolerance. It is part of the body's adaptive immune response and discriminates between foreign and host antigens. IL-2 mediates its effects by binding to IL-2 receptors, which in turn activate downstream signaling events.

Human IL-2 is an FDA approved drug for the treatment of diseases such as metastatic renal carcinoma and melanoma. The use of IL-2 in eligible patients is sometimes restricted due to the severe toxicity associated with IL-2 therapy, and only a small subset of eligible patients will actually receive therapy. The toxicities associated with IL-2 therapy can include severe fever, nausea, vomiting, vascular leak and serious hypotension. Despite these toxicities, however, IL-2 is typically effective for its approved indications.

For patients with various diseases and conditions that are amenable to treatment with IL-2, there continues to be an unmet need for novel IL-2-based agents that exhibit characteristics sufficient for the development of a safe and efficacious therapeutic.

SUMMARY

In an aspect, the disclosure provides a method of treating a transplant rejection or a symptom thereof, comprising administering to a subject in need thereof an effective amount of an IL-2 agent described herein, e.g., an IL-2 variant described herein, or an IL-2 fusion protein described herein, thereby treating the transplant rejection or the symptom thereof.

In an embodiment, the transplant is a heart transplant.

In an embodiment, the level of Tregs in the subject is increased by about 2, 3, 4, 5, 6, 7, 8, 9, 10-fold or more, compared to the level of Tregs in the subject prior to administration of the IL-2 fusion protein. In an embodiment, the level of Tregs is determined in a sample from the subject.

In an embodiment, the IL-2 fusion protein comprises an IL-2 variant described herein.

In an embodiment, the IL-2 variant comprising: (i) (a) the amino acid substitution H16L or H16N, (b) the amino acid substitution I92S, or (c) both (a) and (b); and (ii) the amino acid substitutions V69A, Q74P, and C125S, corresponding to human IL-2 (SEQ ID NO: 1031). In an embodiment, the IL-2 variant further comprises the amino acid substitution T3A. In an embodiment, the IL-2 variant comprises the amino acid sequence of any of SEQ ID NOs: 4, 5, 11, 1000, 1001, or 1002, an amino acid sequence that is at least 95% identical thereto or differs by no more than 1, 2, 3, 4, or 5 amino acids therefrom, or a functional fragment thereof.

In an embodiment, the IL-2 fusion protein further comprises an Fc region. In an embodiment, the Fc region comprises an Fc region of IgG1 allotype m3 comprising an N297G substitution according to EU numbering. In an embodiment, the Fc region comprises the amino acid sequence of SEQ ID NO: 1003, or an amino acid sequence that is at least 95% identical thereto or differs by no more than 1, 2, 3, 4, 5, 6, 7, 8, 9, or 10 amino acids therefrom, or a functional fragment thereof. In an embodiment, the Fc region is fused to the C-terminus of the IL-2 variant. In an embodiment, the IL-2 fusion protein further comprises a linker. In an embodiment, the linker comprises $(G_4S)_4$ (SEQ ID NO: 48). In an embodiment, the fusion protein forms a dimer.

In an embodiment, the fusion protein comprises an amino acid sequence of any of SEQ ID NOs: 1004, 1005, 1006, 1007, 1008, or 1009, an amino acid sequence that is at least 95% identical thereto or differs by no more than 1, 2, 3, 4, 5, 6, 7, 8, 9, or 10 amino acids therefrom, or a functional fragment thereof.

In an embodiment, the method further comprises administering an immunosuppressive agent to the subject. In an embodiment, the immunosuppressive agent comprises rapamycin.

In an embodiment, the subject is a human or a non-human primate. In an embodiment, the subject is a mouse.

In another aspect, the disclosure provides a method of preventing a transplant rejection or a symptom thereof, comprising administering to a subject in need thereof an effective amount of an IL-2 agent described herein, e.g., an IL-2 variant described herein, or an IL-2 fusion protein described herein, thereby preventing the transplant rejection or the symptom thereof.

In an embodiment, the transplant is a heart transplant.

In an embodiment, the level of Tregs in the subject is increased by about 2, 3, 4, 5, 6, 7, 8, 9, 10-fold or more, compared to the level of Tregs in the subject prior to administration of the IL-2 fusion protein. In an embodiment, the level of Tregs is determined in a sample from the subject.

In an embodiment, the IL-2 fusion protein comprises an IL-2 variant described herein.

In an embodiment, the IL-2 variant comprising: (i) (a) the amino acid substitution H16L or H16N, (b) the amino acid substitution I92S, or (c) both (a) and (b); and (ii) the amino acid substitutions V69A, Q74P, and C125S, corresponding to human IL-2 (SEQ ID NO: 1031). In an embodiment, the IL-2 variant further comprises the amino acid substitution T3A. In an embodiment, the IL-2 variant comprises the amino acid sequence of any of SEQ ID NOs: 4, 5, 11, 1000, 1001, or 1002, an amino acid sequence that is at least 95% identical thereto or differs by no more than 1, 2, 3, 4, or 5 amino acids therefrom, or a functional fragment thereof.

In an embodiment, the IL-2 fusion protein further comprises an Fc region. In an embodiment, the Fc region comprises an Fc region of IgG1 allotype m3 comprising an N297G substitution according to EU numbering. In an embodiment, the Fc region comprises the amino acid sequence of SEQ ID NO: 1003, or an amino acid sequence that is at least 95% identical thereto or differs by no more than 1, 2, 3, 4, 5, 6, 7, 8, 9, or 10 amino acids therefrom, or a functional fragment thereof. In an embodiment, the Fc region is fused to the C-terminus of the IL-2 variant. In an embodiment, the IL-2 fusion protein further comprises a linker. In an embodiment, the linker comprises (G$_4$S)$_4$ (SEQ ID NO: 48). In an embodiment, the fusion protein forms a dimer.

In an embodiment, the fusion protein comprises an amino acid sequence of any of SEQ ID NOs: 1004, 1005, 1006, 1007, 1008, or 1009, an amino acid sequence that is at least 95% identical thereto or differs by no more than 1, 2, 3, 4, 5, 6, 7, 8, 9, or 10 amino acids therefrom, or a functional fragment thereof.

In an embodiment, the method further comprises administering an immunosuppressive agent to the subject. In an embodiment, the immunosuppressive agent comprises rapamycin.

In an embodiment, the subject is a human or a non-human primate. In an embodiment, the subject is a mouse.

In yet another aspect, the disclosure provides a method of modulating (e.g., increasing or inducing) immunosuppression for a transplant, comprising administering to a subject in need thereof an effective amount of an IL-2 agent described herein, e.g., an IL-2 variant described herein, or an IL-2 fusion protein described herein, thereby modulating (e.g., increasing or inducing) immunosuppression for a transplant.

In an embodiment, the subject has received, is receiving, or will receive a transplant, when the IL-2 agent is administered to the subject. In an embodiment, the transplant is a heart transplant.

In an embodiment, the level of Tregs in the subject is increased by about 2, 3, 4, 5, 6, 7, 8, 9, 10-fold or more, compared to the level of Tregs in the subject prior to administration of the IL-2 fusion protein. In an embodiment, the level of Tregs is determined in a sample from the subject.

In an embodiment, the IL-2 fusion protein comprises an IL-2 variant described herein.

In an embodiment, the IL-2 variant comprising: (i) (a) the amino acid substitution H16L or H16N, (b) the amino acid substitution I92S, or (c) both (a) and (b); and (ii) the amino acid substitutions V69A, Q74P, and C125S, corresponding to human IL-2 (SEQ ID NO: 1031). In an embodiment, the IL-2 variant further comprises the amino acid substitution T3A. In an embodiment, the IL-2 variant comprises the amino acid sequence of any of SEQ ID NOs: 4, 5, 11, 1000, 1001, or 1002, an amino acid sequence that is at least 95% identical thereto or differs by no more than 1, 2, 3, 4, or 5 amino acids therefrom, or a functional fragment thereof.

In an embodiment, the IL-2 fusion protein further comprises an Fc region. In an embodiment, the Fc region comprises an Fc region of IgG1 allotype m3 comprising an N297G substitution according to EU numbering. In an embodiment, the Fc region comprises the amino acid sequence of SEQ ID NO: 1003, or an amino acid sequence that is at least 95% identical thereto or differs by no more than 1, 2, 3, 4, 5, 6, 7, 8, 9, or 10 amino acids therefrom, or a functional fragment thereof. In an embodiment, the Fc region is fused to the C-terminus of the IL-2 variant. In an embodiment, the IL-2 fusion protein further comprises a linker. In an embodiment, the linker comprises (G$_4$S)$_4$ (SEQ ID NO: 48). In an embodiment, the fusion protein forms a dimer.

In an embodiment, the fusion protein comprises an amino acid sequence of any of SEQ ID NOs: 1004, 1005, 1006, 1007, 1008, or 1009, an amino acid sequence that is at least 95% identical thereto or differs by no more than 1, 2, 3, 4, 5, 6, 7, 8, 9, or 10 amino acids therefrom, or a functional fragment thereof.

In an embodiment, the method further comprises administering an immunosuppressive agent to the subject. In an embodiment, the immunosuppressive agent comprises rapamycin.

In an embodiment, the subject is a human or a non-human primate. In an embodiment, the subject is a mouse.

In still another aspect, the disclosure provides a method of conditioning a subject prior to a transplant, comprising administering to a subject in need thereof an effective amount of an IL-2 agent described herein, e.g., an IL-2 variant described herein, or an IL-2 fusion protein described herein, thereby conditioning the subject prior to the transplant.

In an embodiment, the transplant is a heart transplant.

In an embodiment, the level of Tregs in the subject is increased by about 2, 3, 4, 5, 6, 7, 8, 9, 10-fold or more, compared to the level of Tregs in the subject prior to administration of the IL-2 fusion protein. In an embodiment, the level of Tregs is determined in a sample from the subject.

In an embodiment, the IL-2 fusion protein comprises an IL-2 variant described herein.

In an embodiment, the IL-2 variant comprising: (i) (a) the amino acid substitution H16L or H16N, (b) the amino acid substitution I92S, or (c) both (a) and (b); and (ii) the amino acid substitutions V69A, Q74P, and C125S, corresponding to human IL-2 (SEQ ID NO: 1031). In an embodiment, the IL-2 variant further comprises the amino acid substitution T3A. In an embodiment, the IL-2 variant comprises the amino acid sequence of any of SEQ ID NOs: 4, 5, 11, 1000, 1001, or 1002, an amino acid sequence that is at least 95% identical thereto or differs by no more than 1, 2, 3, 4, or 5 amino acids therefrom, or a functional fragment thereof.

In an embodiment, the IL-2 fusion protein further comprises an Fc region. In an embodiment, the Fc region comprises an Fc region of IgG1 allotype m3 comprising an N297G substitution according to EU numbering. In an embodiment, the Fc region comprises the amino acid sequence of SEQ ID NO: 1003, or an amino acid sequence that is at least 95% identical thereto or differs by no more than 1, 2, 3, 4, 5, 6, 7, 8, 9, or 10 amino acids therefrom, or a functional fragment thereof. In an embodiment, the Fc region is fused to the C-terminus of the IL-2 variant. In an embodiment, the IL-2 fusion protein further comprises a linker. In an embodiment, the linker comprises (G$_4$S)$_4$ (SEQ ID NO: 48). In an embodiment, the fusion protein forms a dimer.

In an embodiment, the fusion protein comprises an amino acid sequence of any of SEQ ID NOs: 1004, 1005, 1006, 1007, 1008, or 1009, an amino acid sequence that is at least 95% identical thereto or differs by no more than 1, 2, 3, 4, 5, 6, 7, 8, 9, or 10 amino acids therefrom, or a functional fragment thereof.

In an embodiment, the method further comprises administering an immunosuppressive agent to the subject. In an embodiment, the immunosuppressive agent comprises rapamycin.

In an embodiment, the subject is a human or a non-human primate. In an embodiment, the subject is a mouse.

In another aspect, the disclosure provides a method of selectively increasing Tregs, comprising administering to a subject in need thereof an effective amount of an IL-2 agent described herein, e.g., an IL-2 variant described herein, or an IL-2 fusion protein described herein, wherein the subject has received, is receiving, or will receive a transplant, thereby selectively increasing Tregs.

In an embodiment, the transplant is a heart transplant.

In an embodiment, the level of Tregs in the subject is increased by about 2, 3, 4, 5, 6, 7, 8, 9, 10-fold or more, compared to the level of Tregs in the subject prior to administration of the IL-2 fusion protein. In an embodiment, the level of Tregs is determined in a sample from the subject.

In an embodiment, the IL-2 fusion protein comprises an IL-2 variant described herein.

In an embodiment, the IL-2 variant comprising: (i) (a) the amino acid substitution H16L or H16N, (b) the amino acid substitution I92S, or (c) both (a) and (b); and (ii) the amino acid substitutions V69A, Q74P, and C125S, corresponding to human IL-2 (SEQ ID NO: 1031). In an embodiment, the IL-2 variant further comprises the amino acid substitution T3A. In an embodiment, the IL-2 variant comprises the amino acid sequence of any of SEQ ID NOs: 4, 5, 11, 1000, 1001, or 1002, an amino acid sequence that is at least 95% identical thereto or differs by no more than 1, 2, 3, 4, or 5 amino acids therefrom, or a functional fragment thereof.

In an embodiment, the IL-2 fusion protein further comprises an Fc region. In an embodiment, the Fc region comprises an Fc region of IgG1 allotype m3 comprising an N297G substitution according to EU numbering. In an embodiment, the Fc region comprises the amino acid sequence of SEQ ID NO: 1003, or an amino acid sequence that is at least 95% identical thereto or differs by no more than 1, 2, 3, 4, 5, 6, 7, 8, 9, or 10 amino acids therefrom, or a functional fragment thereof. In an embodiment, the Fc region is fused to the C-terminus of the IL-2 variant. In an embodiment, the IL-2 fusion protein further comprises a linker. In an embodiment, the linker comprises (G4S)4 (SEQ ID NO: 48). In an embodiment, the fusion protein forms a dimer.

In an embodiment, the fusion protein comprises an amino acid sequence of any of SEQ ID NOs: 1004, 1005, 1006, 1007, 1008, or 1009, an amino acid sequence that is at least 95% identical thereto or differs by no more than 1, 2, 3, 4, 5, 6, 7, 8, 9, or 10 amino acids therefrom, or a functional fragment thereof.

In an embodiment, the method further comprises administering an immunosuppressive agent to the subject. In an embodiment, the immunosuppressive agent comprises rapamycin.

In an embodiment, the subject is a human or a non-human primate. In an embodiment, the subject is a mouse.

In yet another aspect, the disclosure provides a method of treating a heart disease or a symptom thereof, comprising administering to a subject in need thereof an effective amount of an IL-2 agent described herein, e.g., an IL-2 variant described herein, or an IL-2 fusion protein described herein; and providing a heart transplant to the subject, thereby treating the heart disease or the symptom thereof.

In an embodiment, the heart transplant is provided to the subject prior to, concurrent with, or after administration of the IL-2 fusion protein.

In an embodiment, the level of Tregs in the subject is increased by about 2, 3, 4, 5, 6, 7, 8, 9, 10-fold or more, compared to the level of Tregs in the subject prior to administration of the IL-2 fusion protein. In an embodiment, the level of Tregs is determined in a sample from the subject.

In an embodiment, the IL-2 fusion protein comprises an IL-2 variant described herein.

In an embodiment, the IL-2 variant comprising: (i) (a) the amino acid substitution H16L or H16N, (b) the amino acid substitution I92S, or (c) both (a) and (b); and (ii) the amino acid substitutions V69A, Q74P, and C125S, corresponding to human IL-2 (SEQ ID NO: 1031). In an embodiment, the IL-2 variant further comprises the amino acid substitution T3A. In an embodiment, the IL-2 variant comprises the amino acid sequence of any of SEQ ID NOs: 4, 5, 11, 1000, 1001, or 1002, an amino acid sequence that is at least 95% identical thereto or differs by no more than 1, 2, 3, 4, or 5 amino acids therefrom, or a functional fragment thereof.

In an embodiment, the IL-2 fusion protein further comprises an Fc region. In an embodiment, the Fc region comprises an Fc region of IgG1 allotype m3 comprising an N297G substitution according to EU numbering. In an embodiment, the Fc region comprises the amino acid sequence of SEQ ID NO: 1003, or an amino acid sequence that is at least 95% identical thereto or differs by no more than 1, 2, 3, 4, 5, 6, 7, 8, 9, or 10 amino acids therefrom, or a functional fragment thereof. In an embodiment, the Fc region is fused to the C-terminus of the IL-2 variant. In an embodiment, the IL-2 fusion protein further comprises a linker. In an embodiment, the linker comprises (G4S)4 (SEQ ID NO: 48). In an embodiment, the fusion protein forms a dimer.

In an embodiment, the fusion protein comprises an amino acid sequence of any of SEQ ID NOs: 1004, 1005, 1006, 1007, 1008, or 1009, an amino acid sequence that is at least 95% identical thereto or differs by no more than 1, 2, 3, 4, 5, 6, 7, 8, 9, or 10 amino acids therefrom, or a functional fragment thereof.

In an embodiment, the method further comprises administering an immunosuppressive agent to the subject. In an embodiment, the immunosuppressive agent comprises rapamycin.

In an embodiment, the subject is a human or a non-human primate. In an embodiment, the subject is a mouse.

In another aspect, the disclosure provides a combination comprising an IL-2 agent described herein, e.g., an IL-2 variant described herein, or an IL-2 fusion protein described herein, and a transplant. In an embodiment, the transplant is a heart transplant. In an embodiment, the transplant further comprises one or more additional immunosuppressive agents, e.g., rapamycin.

In an embodiment, the combination is for use in treating or preventing a transplant rejection in a subject. In an embodiment, the transplant rejection is a heart transplant rejection. In an embodiment, the IL-2 agent is administered to the subject prior to, during, and/or after the transplant.

In an embodiment, the combination is for use in modulating (e.g., increasing or inducing), immunosuppression in a subject. In an embodiment, the combination is for use in selectively increasing T regulatory cells in a subject. In an embodiment, the subject is a human or a non-human primate. In an embodiment, the subject is a mouse.

In an aspect, the disclosure provides an IL-2 agent described herein, e.g., an IL-2 variant described herein, or an IL-2 fusion protein described herein, for use in a method of treating a transplant rejection or a symptom thereof in a subject, as described herein.

In another aspect, the disclosure provides an IL-2 agent described herein, e.g., an IL-2 variant described herein, or an IL-2 fusion protein described herein, for use in a method of preventing a transplant rejection or a symptom thereof in a subject, as described herein.

In yet another aspect, the disclosure provides an IL-2 agent described herein, e.g., an IL-2 variant described herein, or an IL-2 fusion protein described herein, for use in a method of modulating (e.g., increasing or inducing) immunosuppression for a transplant in a subject, as described herein.

In still another aspect, the disclosure provides an IL-2 agent described herein, e.g., an IL-2 variant described herein, or an IL-2 fusion protein described herein, for use in a method of conditioning a subject prior to a transplant, as described herein.

In another aspect, the disclosure provides an IL-2 agent described herein, e.g., an IL-2 variant described herein, or an IL-2 fusion protein described herein, for use in a method of selectively increasing Tregs in a subject, as described herein, e.g., wherein the subject has received, is receiving, or will receive a transplant.

In yet another aspect, the disclosure provides an IL-2 agent described herein, e.g., an IL-2 variant described herein, or an IL-2 fusion protein described herein, in combination with a heart transplant, for use in a method of treating a heart disease or a symptom thereof in a subject, as described herein.

In an aspect, the disclosure provides use of an IL-2 agent described herein, e.g., an IL-2 variant described herein, or an IL-2 fusion protein described herein, in the manufacture of a medicament for treating a transplant rejection or a symptom thereof in a subject, as described herein.

In another aspect, the disclosure provides use of an IL-2 agent described herein, e.g., an IL-2 variant described herein, or an IL-2 fusion protein described herein, in the manufacture of a medicament for preventing a transplant rejection or a symptom thereof in a subject, as described herein.

In yet another aspect, the disclosure provides use of an IL-2 agent described herein, e.g., an IL-2 variant described herein, or an IL-2 fusion protein described herein, in the manufacture of a medicament for modulating (e.g., increasing or inducing) immunosuppression for a transplant in a subject, as described herein.

In still another aspect, the disclosure provides use of an IL-2 agent described herein, e.g., an IL-2 variant described herein, or an IL-2 fusion protein described herein, in the manufacture of a medicament for conditioning a subject prior to a transplant, as described herein.

In another aspect, the disclosure provides use of an IL-2 agent described herein, e.g., an IL-2 variant described herein, or an IL-2 fusion protein described herein, in the manufacture of a medicament for selectively increasing Tregs in a subject, as described herein, e.g., wherein the subject has received, is receiving, or will receive a transplant.

In yet another aspect, the disclosure provides use of an IL-2 agent described herein, e.g., an IL-2 variant described herein, or an IL-2 fusion protein described herein, in combination with a heart transplant, in the manufacture of a medicament for treating a heart disease or a symptom thereof in a subject, as described herein.

BRIEF DESCRIPTION OF THE DRAWINGS

FIGS. 1A and 1B are a series of flow cytometry plots showing that in the presence of TGF-β, an exemplary IL-2 mutein promoted murine inducible Treg (iTreg) development in vitro. Treatment in the absence (FIG. 1A) or presence (FIG. 1B) of 3 ng/ml TGFβ1 are indicated. Treatment with beads only, IL-2/0.5 ug/ml, IL-2/5 ug/ml, IL-2m 0.5 ug/ml, or IL-2m 5 ug/ml are also indicated. X-axis: FL9-A::CD4 PB450-A, y-axis: FL1-A::YFP FITC-A.

FIG. 2A depicts Tyr-694 with p-Stat5b indicated by the arrow, and FIG. 2B depicts total. Lanes 1-4: beads only; 5-8: beads+IL-2 10 ug/ml; 9-12: beads+IL-2m 10 ug/ml. Fresh, 10, 30, and 60 min.

FIG. 5 is a graph showing the survival of a murine cardiac allograft model (BALB/c→C57BL/6, n=5) receiving post-Tx IL-2C mutein (10 ug/mouse/2x/w/3 weeks). This demonstrated the efficacy of post-Tx IL-2C mutein therapy alone in murine cardiac allograft recipients.

DETAILED DESCRIPTION

Figure 1A:
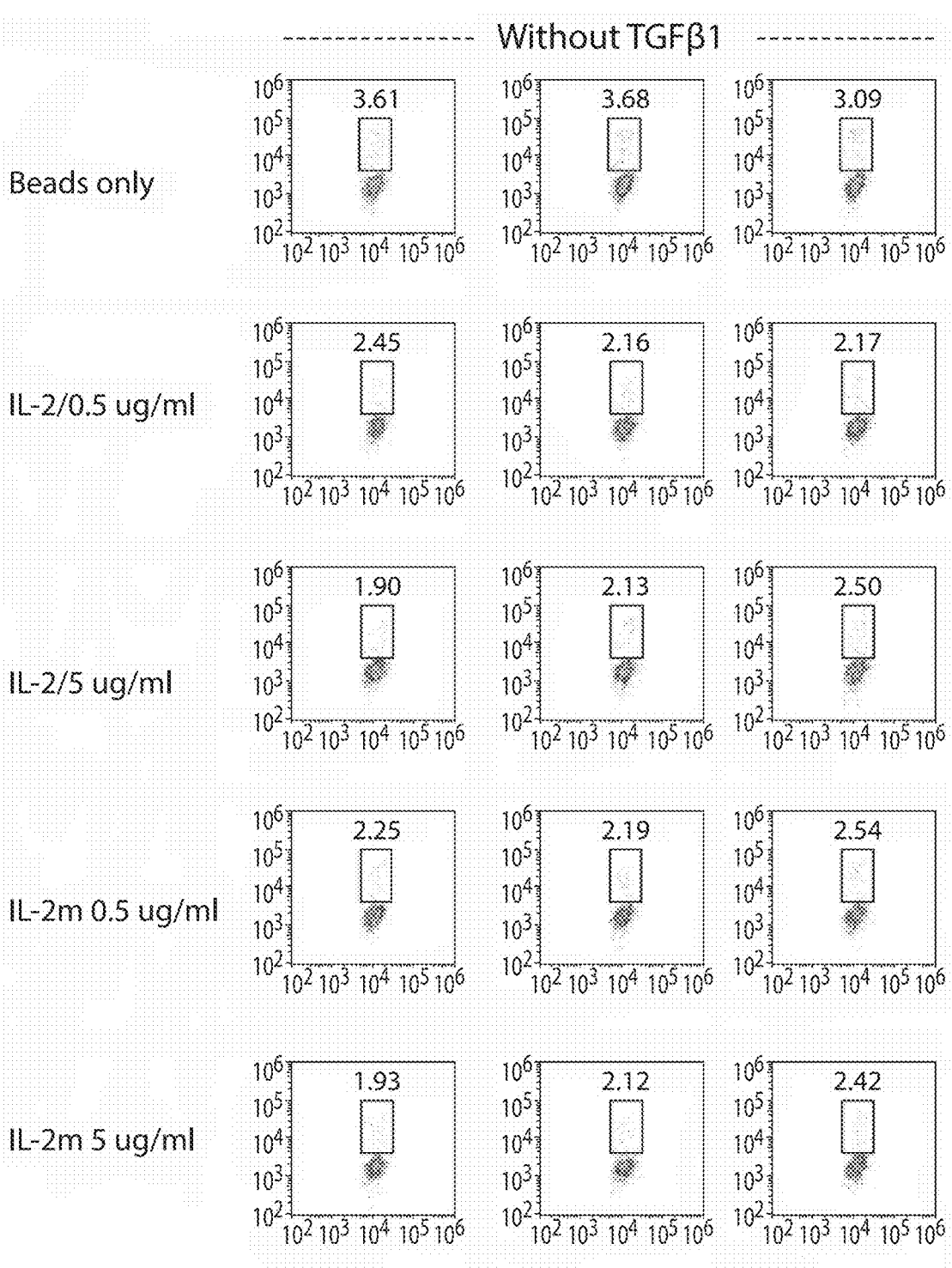
Figure 2A:
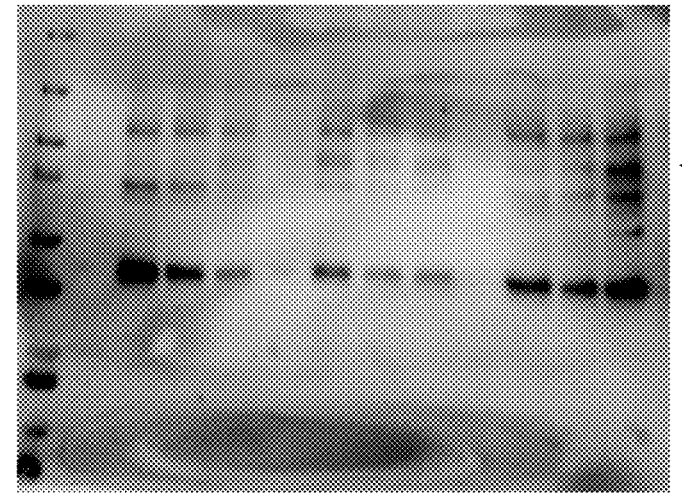
FIGS. 2A and 2B are immunoblots showing that an exemplary IL-2 mutein promoted Stat5 tyrosine phosphorylation (Y694) signaling from the IL-2R in Tregs.
Figure 2B:
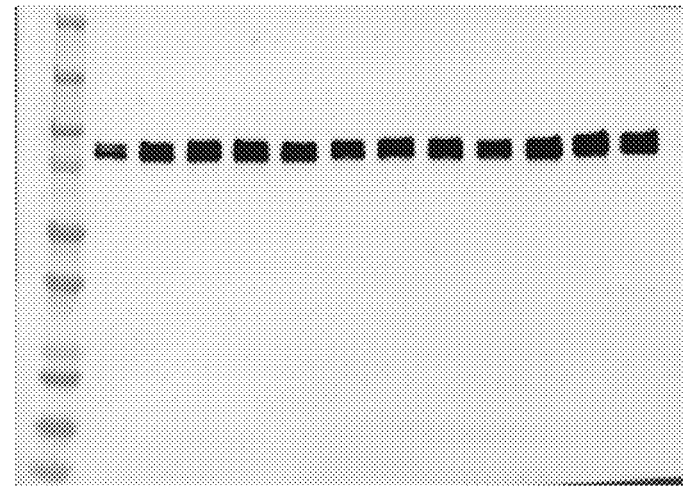

The disclosure is based, at least in part, the discovery that a brief course of therapy with a selected IL-2 mutein can expand recipient Foxp3+ Treg cells and induce donor-specific allograft survival. Without wishing to be bound by theory, it is believed that in some embodiments, IL-2 muteins promote iTreg development in vitro and in vivo, and their efficacy is superior to that of native IL-2 in terms of promoting murine allograft survival. As disclosed herein, pre- and post-treatment therapy prolonged allograft survival, especially when combined with a brief sub-therapeutic course of RPM. For example, three weeks of IL-2 mutein therapy post-treatment plus 2 weeks of rapamycin (RPM) induced long-term cardiac allograft survival. Hearts at >100 days showed essentially normal histology and recipients promptly rejected third party cardiac allografts.

Definitions

As used herein, the articles "a" and "an" refer to one or to more than one (e.g., to at least one) of the grammatical object of the article.

The term "or" is used herein to mean, and is used interchangeably with, the term "and/or", unless context clearly indicates otherwise.

"About" and "approximately" shall generally mean an acceptable degree of error for the quantity measured given the nature or precision of the measurements. Exemplary degrees of error are within 20 percent (%), typically, within 10%, and more typically, within 5% of a given value or range of values. When "about" or "approximately" is present before a series of numbers or a range, it is understood that "about" or "approximately" can modify each of the numbers in the series or range. Similarly, when "at least," "more than," "no more than," "less than," "no less than," or "within" is present before a series of numbers or a range, it is understood that "at least," "more than," "no more than," "less than," "no less than," or "within" can modify each of the numbers in the series or range. As used herein, ranges include both the upper and lower limit.

The compositions and methods disclosed herein encompass polypeptides and nucleic acids having the sequences specified, or sequences substantially identical or similar thereto, e.g., sequences at least 85%, 90%, 95% identical or higher to the sequence specified.

In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 85%, 90%, 91%, 92%, 93%, 94%, 95%, 96%, 97%, 98% or 99% identity to a reference sequence, e.g., a sequence provided herein.

In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 85%, 90%, 91%, 92%, 93%, 94%, 95%, 96%, 97%, 98% or 99% identity to a reference sequence, e.g., a sequence provided herein.

The term "functional variant" refers polypeptides that have a substantially identical amino acid sequence to the naturally-occurring sequence, or are encoded by a substantially identical nucleotide sequence, and are capable of having one or more activities of the naturally-occurring sequence.

Calculations of homology or sequence identity between sequences (the terms are used interchangeably herein) are performed as follows.

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a typical embodiment, the length of a reference sequence aligned for comparison purposes is at least 30%, e.g., at least 40%, 50%, 60%, e.g., at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position.

The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In an embodiment, the percent identity between two amino acid sequences is determined using the Needleman and Wunsch ((1970) *J. Mol. Biol.* 48:444-453) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6. In certain embodiments, the percent identity between two nucleotide sequences is determined using the GAP program in the GCG software package (available at www.gcg.com), using a NWSgapdna.CMP matrix and a gap weight of 40, 50, 60, 70, or 80 and a length weight of 1, 2, 3, 4, 5, or 6. One suitable set of parameters (and the one that should be used unless otherwise specified) are a Blossum 62 scoring matrix with a gap penalty of 12, a gap extend penalty of 4, and a frameshift gap penalty of 5.

The percent identity between two amino acid or nucleotide sequences can be determined using the algorithm of E. Meyers and W. Miller ((1989) CABIOS, 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al. (1990) *J. Mol. Biol.* 215: 403-10. BLAST nucleotide searches can be performed with the NBLAST program, score=100, wordlength=12 to obtain nucleotide sequences homologous to a nucleic acid as described herein. BLAST protein searches can be performed with the XBLAST program, score=50, wordlength=3 to obtain amino acid sequences homologous to protein molecules described herein. To obtain gapped alignments for comparison purposes, Gapped BLAST can be utilized as described in Altschul et al., (1997) *Nucleic Acids Res.* 25:3389-3402. When utilizing BLAST and gapped BLAST programs, the default parameters of the respective programs (e.g., XBLAST and NBLAST) can be used. See www.ncbi.nlm.nih.gov.

As used herein, the term "hybridizes under low stringency, medium stringency, high stringency, or very high stringency conditions" describes conditions for hybridization and washing. Guidance for performing hybridization reactions can be found in *Current Protocols in Molecular*

*Biology*, John Wiley & Sons, N.Y. (1989), 6.3.1-6.3.6, which is incorporated by reference. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions 4) are suitable conditions and the ones that should be used unless otherwise specified.

It is understood that the molecules described herein may have additional conservative or non-essential amino acid substitutions, which do not have a substantial effect on their functions.

The term "amino acid" is intended to embrace all molecules, whether natural or synthetic, which include both an amino functionality and an acid functionality and capable of being included in a polymer of naturally-occurring amino acids. Exemplary amino acids include naturally-occurring amino acids; analogs, derivatives and congeners thereof; amino acid analogs having variant side chains; and all stereoisomers of any of any of the foregoing. As used herein the term "amino acid" includes both the D- or L-optical isomers and peptidomimetics.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

The terms "polypeptide," "peptide" and "protein" (if single chain) are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

As recognized by those skilled in the art, protein fragments, functional protein domains, and homologous proteins are also considered to be within the scope of this invention. For example, provided herein is any protein fragment of a reference protein (meaning a polypeptide sequence at least one amino acid residue shorter than a reference polypeptide sequence but otherwise identical) 5, 10, 15, 20, 25, 30, 35, 40, 45, 50, 55, 60, 70, 80, 90, 100, or greater than 100 amino acids in length In another example, any protein that includes a stretch of about 20, about 30, about 40, about 50, or about 100 amino acids which are about 40%, about 50%, about 60%, about 70%, about 80%, about 90%, about 95%, about 98%, or about 100% identical to any of the sequences described herein can be utilized in accordance with the invention. In an embodiment, a protein sequence to be utilized in accordance with the disclosure includes 2, 3, 4, 5, 6, 7, 8, 9, 10, or more mutations as shown in any of the sequences provided or referenced herein.

The terms "nucleic acid," "nucleic acid sequence," "nucleotide sequence," or "polynucleotide sequence," and "polynucleotide" are used interchangeably. They refer to a polymeric form of nucleotides of any length, either deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

The term "isolated," as used herein, refers to material that is removed from its original or native environment (e.g., the natural environment if it is naturally occurring). For example, a naturally-occurring polynucleotide or polypeptide present in a living animal is not isolated, but the same polynucleotide or polypeptide, separated by human intervention from some or all of the co-existing materials in the natural system, is isolated. Such polynucleotides could be part of a vector and/or such polynucleotides or polypeptides could be part of a composition, and still be isolated in that such vector or composition is not part of the environment in which it is found in nature.

As used herein, the term "treat," a disorder, e.g., a myeloma, means that a subject (e.g., a human) who has a disorder, e.g., a myeloma, and/or experiences a symptom of a disorder, e.g., a myeloma, will, in an embodiment, suffer less a severe symptom and/or recover faster when an antibody molecule is administered than if the antibody molecule were never administered. In an embodiment, when a myeloma is treated, a bone marrow biopsy will show fewer clonal plasma cells, after effective treatment for myeloma. For example, a diagnostic assay will detect fewer clonal plasma cells in a biological sample of a subject after administration of an antibody molecule described herein for the effective treatment of a myeloma. Other assays, urine tests, or blood tests, can also be used to monitor treatment in a patient, or to detect the presence, e.g., decreased presence (or absence), of a symptom of a myeloma, after treatment of a myeloma in the subject. In an embodiment, when a myeloma is treated, the level of β2 microglobulin (β2M) in serum or urine will be decreased, after effective treatment for myeloma. Treatment can, e.g., partially or completely, alleviate, ameliorate, relieve, inhibit, or reduce the severity of, and/or reduce incidence, and optionally, delay onset of, one or more manifestations of the effects or symptoms, features, and/or causes of a disorder, e.g., a myeloma. In an embodiment, treatment is of a subject who does not exhibit certain signs of a disorder, e.g., a myeloma, and/or of a subject who exhibits only early signs of a disorder, e.g., nephropathy. In an embodiment, treatment is of a subject who exhibits one or more established signs of a disorder, e.g., a myeloma. In an embodiment, treatment is of a subject diagnosed as suffering from a disorder, e.g., a myeloma.

As used herein, the term "prevent," a disorder, e.g., a myeloma, means that a subject (e.g., a human) is less likely to have the disorder, e.g., a myeloma, if the subject receives the antibody molecule.

Various aspects of the compositions and methods herein are described in further detail below. Additional definitions are set out throughout the specification.

IL-2 Agents

The present disclosure provides IL-2 agents, including, but not limited to, IL-2 variants, IL-2 fusion proteins, IL-2 complexes, and IL-2 conjugates. For example, the IL-2 agents described herein can have one or more structural and/or functional properties described herein. In an embodiment, the IL-2 agent comprises an IL-2 variant comprising one or more amino acid alterations (e.g., substitutions) described herein. In an embodiment, the IL-2 agent comprises an IL-2 variant comprising one or more amino acid alterations (e.g., substitutions) described in Table 9. In an embodiment, the IL-2 agent comprises an IL-2 variant comprising an amino acid sequence described in Table 9, or a portion thereof. In an embodiment, the IL-2 agent, or a portion thereof, is encoded by a nucleic acid comprising a nucleotide sequence described herein, e.g., in Table 10. The one or more amino acid alterations (e.g., substitutions), alone or in combination, may confer one or more desired biological properties described herein. In an embodiment, the IL-2 agent can modulate (e.g., increase) Treg prolifera- tion, survival, activation and/or function. In an embodiment, the modulation is selective or specific for the Tregs. For example, the IL-2 agent is capable of modulating the activity in Tregs but has limited or lacks the ability to promote the activity in non-regulatory T cells. In an embodiment, the IL-2 agent comprises a polypeptide (sometime referred to herein as "IL-2 polypeptide agent").

IL-2 Variants

In an embodiment, the IL-2 agent comprises an IL-2 variant, e.g., an IL-2 variant described herein.

In an embodiment, the IL-2 variant comprises an IL-2 polypeptide (e.g., a human IL-2 polypeptide) described herein, or a functional fragment thereof. In an embodiment, the IL-2 variant comprises one or more amino acid altera- tions (e.g., substitutions) described in Table 9. In an embodi- ment, the IL-2 variant comprises, or consists of, an amino acid sequence described in Table 9, or a functional fragment thereof. In an embodiment, the IL-2 variant is encoded by a nucleic acid comprising a nucleotide sequence described herein, e.g., in Table 10.

Without wishing to be bound by theory, it is believed that in an embodiment, the IL-2 variants described herein, which have reduced human CD25 and/or reduced human CD122/ CD132 binding affinity relative to a wild-type human IL-2 or a reference IL-2 variant, can have improved potency and/or selectivity for binding to and activating regulatory T cells (Tregs) than wild type IL-2 or other IL-2 variants. The IL-2 variants described herein can be identified, e.g., by screening a library of mutated IL-2 polypeptides to identify IL-2 variants having a binding affinity for human CD25 and/or human CD122/CD132 in a desired range.

In an embodiment, the IL-2 variant has one or more (e.g., 2, 3, 4, 5, 6, 7, 8, 9, 10, 11, 12, or more) properties described herein, e.g., different and/or improved properties, relative to a wild-type IL-2 or a reference IL-2 variant. In an embodi- ment, the IL-2 variant comprises one or more (e.g., 2, 3, 4, 5, 6, 7, 8, 9, 10, or more) amino acid alterations (e.g., substitutions) that provide different and/or improved prop- erties, relative to a wild-type IL-2 or a reference IL-2 variant. In an embodiment, the IL-2 variant has one or more (e.g., 2, 3, 4, 5, 6, 7, 8, 9, 10, 11, 12, or all) of the following different and/or improved properties (e.g., as determined by an assay described herein), relative to a wild-type IL-2 or a reference IL-2 variant:

i) altered (e.g., enhanced or increased) expression in vitro and/or in vivo;

ii) altered (e.g., reduced or decreased) aggregation in vitro and/or in vivo;

iii) altered (e.g., enhanced or increased) stability in vitro and/or in vivo;

iv) altered (e.g., enhanced or increased) half-life in vitro and/or in vivo;

v) altered (e.g., reduced or decreased) turnover and/or clearance in vivo;

vi) altered (e.g., reduced or decreased) susceptibility to proteolysis in vitro and/or in vivo;

vii) altered (e.g., enhanced or increased) resistance to proteolysis in vitro and/or in vivo;

viii) altered (e.g., reduced or decreased) binding capacity and/or binding affinity for human CD25 in vitro and/or in vivo;

ix) altered (e.g., reduced or decreased) binding capacity and/or binding affinity for human CD132 in vitro and/or in vivo;

x) altered (e.g., reduced or decreased) binding capacity and/or binding affinity for the dimeric IL-2 receptor comprising human CD122 and human CD132 in vitro and/or in vivo;

xi) altered (e.g., enhanced, increased, reduced, decreased, and/or selective) binding to Tregs in vitro and/or in vivo;

xii) altered (e.g., enhanced, increased, reduced, decreased, and/or selective) activation of the IL-2 signaling path- way in Tregs in vitro and/or in vivo;

xiii) altered (e.g., enhanced, increased, reduced, decreased, and/or selective) ability to induce or pro- mote Treg expansion, activity, survival, and/or prolif- eration in vitro and/or in vivo.

In an embodiment, the IL-2 variant has altered (e.g., enhanced or increased) expression in vitro and/or in vivo, relative to a wild-type IL-2 or a reference IL-2 variant. In an embodiment, the IL-2 variant has enhanced or increased expression (e.g., in a bacterial or mammalian cell) relative to a wild-type IL-2. In an embodiment, the IL-2 variant has enhanced or increased expression (e.g., in bacterial or mam- malian cell) relative to a reference IL-2 variant. In an embodiment, the expression of the IL-2 variant is increased by about 1%, 5%, 10%, 20%, 30%, 40%, 50%, 60%, 70%, 80%, 90%, 95%, or about 100%, or more. In an embodi- ment, the expression of the IL-2 variant is increased by about 0.5-fold, 1-fold, 2-fold, 3-fold, 4-fold, 5-fold, 6-fold, 7-fold, 8-fold, 9-fold, or about 10-fold, or more. In an embodiment, the IL-2 variant expresses at a higher or increased level in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more e.g., relative to an IL-2 agent comprising a wild-type IL-2 or an IL-2 agent comprising a reference IL-2 variant e.g., as determined by an assay of protein concentration. In an embodiment, the IL-2 variant expresses at a higher or increased level, e.g., increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined by an assay of protein concentration.

In an embodiment, the IL-2 variant has altered (e.g., reduced or decreased) aggregation in vitro and/or in vivo, relative to a wild-type IL-2 or a reference IL-2 variant. In an embodiment, the IL-2 variant has reduced or decreased aggregation relative to a wild type IL-2. In an embodiment, the IL-2 variant has reduced or decreased aggregation relative to a reference IL-2 variant. In an embodiment, the aggregation of the IL-2 variant is decreased by about 1%, 5%, 10%, 20%, 30%, 40%, 50%, 60%, 70%, 80%, 90%, 95%, or about 100%, or more. In an embodiment, the aggregation of the IL-2 variant is decreased by about 0.5-fold, 1-fold, 2-fold, 3-fold, 4-fold, 5-fold, 6-fold, 7-fold, 8-fold, 9-fold, or about 10-fold, or more. In an embodiment, an IL-2 agent comprising an IL-2 variant described herein aggregates at lower or decreased level in vitro and/or in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more e.g., relative to an IL-2 agent comprising a wild-type IL-2 or an IL-2 agent comprising a reference IL-2 variant e.g., as determined by melting temperature analysis (e.g., using fluorimetry), dynamic light scattering, and/or size-exclusion chromatography. In an embodiment, an IL-2 agent comprising an IL-2 variant described herein aggregates at lower or decreased level, e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant, e.g., as determined by melting temperature analysis (e.g., using fluorimetry), dynamic light scattering, and/or size-exclusion chromatography.

In an embodiment, the IL-2 variant has altered (e.g., enhanced or increased) stability in vitro and/or in vivo, relative to a wild-type IL-2 or a reference IL-2 variant. In an embodiment, the IL-2 variant has enhanced or increased stability relative to a wild-type IL-2. In an embodiment, the IL-2 variant has enhanced or increased stability relative to a reference IL-2 variant. In an embodiment, the stability of the IL-2 variant is increased by about 1%, 5%, 10%, 20%, 30%, 40%, 50%, 60%, 70%, 80%, 90%, 95%, or about 100%, or more. In an embodiment, the stability of the IL-2 variant is increased by about 0.5-fold, 1-fold, 2-fold, 3-fold, 4-fold, 5-fold, 6-fold, 7-fold, 8-fold, 9-fold, or about 10-fold, or more. In an embodiment, an IL-2 agent comprising an IL-variant described herein has enhanced or increased stability in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant, e.g., as determined by yeast surface display, circular dichroism or related spectroscopic techniques, and/or melting temperature analysis (e.g., using fluorimetry).

In an embodiment, the IL-2 variant has altered (e.g., enhanced or increased) half-life in vitro and/or in vivo, relative to a wild-type IL-2 or a reference IL-2 variant. In an embodiment, the IL-2 variant has enhanced or increased half-life relative to a wild-type IL-2. In an embodiment, the IL-2 variant has enhanced or increased half-life relative to a reference IL-2 variant. In an embodiment, the half-life of the IL-2 variant is increased by about 1%, 5%, 10%, 20%, 30%, 40%, 50%, 60%, 70%, 80%, 90%, 95%, or about 100%, or more. In an embodiment, the half-life of the IL-2 variant is increased by about 0.5-fold, 1-fold, 2-fold, 3-fold, 4-fold, 5-fold, 6-fold, 7-fold, 8-fold, 9-fold, or about 10-fold, or more. In an embodiment, an IL-2 agent comprising an IL-2 variant described herein has enhanced or increased half-life in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., greater than about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant, e.g., as determined by ELISA, flow cytometry, and/or mass spectrometry.

In an embodiment, the IL-2 variant has altered (e.g., reduced or decreased) turnover in vitro and/or in vivo, relative to a wild-type IL-2 or a reference IL-2 variant. In an embodiment, the IL-2 variant has reduced or decreased turnover relative to a wild-type IL-2. In an embodiment, the IL-2 variant has reduced or decreased turnover relative to a reference IL-2 variant. In an embodiment, the turnover of the IL-2 variant is decreased by about 1%, 5%, 10%, 20%, 30%, 40%, 50%, 60%, 70%, 80%, 90%, 95%, or about 100%, or more. In an embodiment, the turnover of the IL-2 variant is decreased by about 0.5-fold, 1-fold, 2-fold, 3-fold, 4-fold, 5-fold, 6-fold, 7-fold, 8-fold, 9-fold, about 10-fold, or more. In an embodiment, an IL-2 agent comprising an IL-2 variant described herein has a lower, reduced or decreased rate or level of turnover and/or clearance in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant, e.g., as determined by ELISA, flow cytometry, and/or mass spectrometry.

In an embodiment, the IL-2 has altered (e.g., reduced or decreased) susceptibility to proteolysis in vitro and/or in vivo, relative to a wild-type IL-2 or a reference IL-2 variant. In an embodiment, the IL-2 variant has reduced or decreased susceptibility to proteolysis relative to IL-2 (e.g., wild type human IL-2). In an embodiment, the IL-2 variant has reduced or decreased susceptibility to proteolysis relative to a reference IL-2 variant. In an embodiment, the susceptibility to proteolysis of the IL-2 variant is decreased by about 1%, 5%, 10%, 20%, 30%, 40%, 50%, 60%, 70%, 80%, 90%, 95%, or about 100%, or more. In an embodiment, the susceptibility to proteolysis of the IL-2 variant is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has altered (e.g., enhanced or increased) resistance to proteolysis in vitro and/or in vivo, relative to a wild-type IL-2 or a reference IL-2 variant. In an embodiment, the IL-2 variant has enhanced or increased resistance to proteolysis relative to a wild-type IL-2. In an embodiment, the IL-2 variant has enhanced or increased resistance to proteolysis relative to a reference IL-2 variant. In an embodiment, the resistance to proteolysis of the IL-2 variant is increased by about 1%, 5%, 10%, 20%, 30%, 40%, 50%, 60%, 70%, 80%, 90%, 95%, or about 100%, or more. In an embodiment, the resistance to proteolysis of the IL-2 variant is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has altered (e.g., reduced or decreased) binding capacity and/or binding affinity for human CD25 in vitro and/or in vivo, relative to a wild-type IL-2 or a reference IL-2 variant. In an embodiment, the IL-2 variant has reduced or decreased binding capacity and/or binding affinity for human CD25 relative to a wild-type human IL-2). In an embodiment, the IL-2 variant has reduced or decreased binding capacity and/or binding affinity for human CD25 relative to a reference IL-2 variant. In an embodiment, the binding capacity and/or binding affinity of the IL-2 variant for human CD25 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 variant for human CD25 is decreased by about 0.5-fold, 1-fold, 2-fold, 3-fold, 4-fold, 5-fold, 6-fold, 7-fold, 8-fold, 9-fold, or about 10-fold, or more. In an embodiment, an IL-2 agent comprising an IL-2 variant described herein has reduced or decreased binding affinity for CD25 (e.g., human CD25), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined by yeast surface display, surface plasmon resonance (e.g. Biacore) and/or bio-layer interferometry (e.g. Octet binding).

In an embodiment, the IL-2 variant binds to CD25 (e.g., human CD25) with low affinity, e.g., with a dissociation constant ($K_D$) of about 5-500 pM, e.g., about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, or e.g., about 10 to about 400 pM, about 20 to about 300 pM, about 50 to about 200 pM, about 100 to about 150 pM, about 5 to about 10 pM, e.g., about 10 to about 20 pM, about 20 to about 30 pM, or about 30 to about 40 pM, e.g., about 40 to about 50 pM, about 50 to about 60 pM, about 60 to about 70 pM, about 70 to about 80 pM, about 80 to about 90 pM, about 90 to about 100 pM, about 100 to about 110 pM, about 110 to about 120 pM, about 120 to about 130 pM, about 130 to about 140 pM about 140 to about 150 pM, about 150 to about 200 pM, about 200 to about 250 pM, about 250 to about 300 pM, about 300 to about 350 pM, about 350 to about 400 pM, about 400 to about 500 pM, or e.g., greater than about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, e.g. as determined by yeast surface display, surface plasmon resonance (e.g. Biacore) and/or biolayer interferometry (e.g. Octet binding).

In an embodiment, the IL-2 variant binds to CD25 (e.g., human CD25) with low affinity, e.g., with a dissociation constant ($K_D$) of about 0.1-10 nM, e.g., about 0.1, about 0.2, about 0.3, about 0.4, about 0.5, about 0.6, about 0.7, about 0.8, about 0.9, about 1, about 1.5, about 2, about 2.5, about 3, about 3.5, about 4, about 4.5, about 5, about 6, about 7, about 8, about 9, or about 10 nM, or e.g., about 0.2 to about 5 nM, about 0.5 to about 2 nM, about 1 to 1.5 nM, about 0.1 to about 0.2 nM, e.g., about 0.2 to about 0.3 nM, about 0.3 to about 0.4 nM, or about 0.4 to about 0.5 nM, e.g., about 0.5 to about 0.6 nM, about 0.6 to about 0.7 nM, about 0.7 to about 0.8 nM, about 0.8 to about 0.9 nM, about 0.9 to about 1 nM, about 1 to about 1.5 nM, about 1.5 to about 2 nM, about 2.5 to about 3 nM, about 3.5 to about 4 nM, about 4 to about 4.5 nM, about 4.5 to about 5 nM, about 5 to about 6 nM, about 6 to about 7 nM, about 7 to about 8 nM, about 8 to about 9 nM, or about 9 to about 10 nM, or e.g., greater than about 0.1, about 0.2, about 0.3, about 0.4, about 0.5, about 0.6, about 0.7, about 0.8, about 0.9, about 1, about 2, about 3, about 4, about 5, about 6, about 7, about 8, about 9, or about 10 nM, e.g., as determined by surface plasmon resonance (e.g. Biacore) and/or bio-layer interferometry (e.g., Octet binding).

In an embodiment, the IL-2 variant has altered (e.g., reduced or decreased) binding capacity and/or binding affinity for human CD132 in vitro and/or in vivo, relative to a wild-type IL-2 or a reference IL-2 variant. In an embodiment, the IL-2 variant has reduced or decreased binding capacity and/or binding affinity for human CD132 relative to a wild-type IL-2. In an embodiment, the IL-2 variant has reduced or decreased binding capacity and/or binding affinity for human CD132 relative to a reference IL-2 variant. In an embodiment, the binding capacity and/or binding affinity of the IL-2 variant for human CD132 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 variant for human CD132 is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has altered (e.g., reduced or decreased) binding capacity and/or binding affinity for the human dimeric IL-2 receptor comprising human CD122 and human CD132 in vitro and/or in vivo, relative to a wild-type IL-2 or a reference IL-2 variant. In an embodiment, the IL-2 variant has reduced or decreased binding capacity and/or binding affinity for the human dimeric IL-2 receptor comprising human CD122 and human CD132 relative to a wild-type IL-2. In an embodiment, the IL-2 variant has reduced or decreased binding capacity and/or binding affinity for the human dimeric IL-2 receptor comprising human CD122 and human CD132 relative to a reference IL-2 variant. In an embodiment, the binding capacity and/or binding affinity of the IL-2 variant for the human dimeric IL-2 receptor comprising human CD122 and human CD132 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 variant for the human dimeric IL-2 receptor comprising human CD122 and human CD132 is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has reduced or decreased binding affinity for CD122/CD132 heterodimer (e.g., human CD122/CD132 heterodimer), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined by yeast surface display, surface plasmon resonance (e.g. Biacore) and/or bio-layer interferometry (e.g. Octet binding).

In an embodiment, the IL-2 variant binds to CD122/CD132 heterodimer (e.g., human CD122/CD132 heterodimer) with low affinity, e.g., with a dissociation constant (KD) of about 0.2-20 nM, e.g., about 0.2, about 0.3, about 0.4, about 0.5, about 0.6, about 0.7, about 0.8, about 0.9, about 1, about 1.1, about 1.2, about 1.3, about 1.4, about 1.5, about 2, about 3, about 4, about 5, about 6, about 7, about 8, about 9, about 10, about 11, about 12, about 13, about 14, about 15, about 16, about 17, about 18, or about 20 nM, or e.g., about 0.5 to about 15 nM, about 1 to about 10 nM, about 2 to about 5 nM, about 0.2 to about 0.3 nM, about 0.3 to about 0.4 nM, about 0.4 to about 0.5 nM, about 0.5 to about 0.6 nM, about 0.6 to about 0.7 nM, about 0.7 to about 0.8 nM, about 0.8 to about 0.9 nM, about 0.9 to about 1 nM, about 1 to about 1.1 nM, about 1.1 to about 1.2 nM, about 1.2 to about 1.3 nM, about 1.3 to about 1.4 nM, about 1.4 to about 1.5 nM, about 1.5 to about 2 nM, about 2 to about 3 nM, about 3 to about 4 nM, about 4 to about 5 nM, about 5 to about 6 nM, about 6 to about 7 nM, about 7 to about 8 nM, about 8 to about 9 nM, about 9 to about 10 nM, about 10 to about 11 nM, about 11 to about 12 nM, about 12 to about 13 nM, about 13 to about 14 nM, about 14 to about 15 nM, about 15 to about 16 nM, about 16 to about 17 nM, about 17 to about 18 nM, about 18 to about 19 nM, or about 19 to about 20 nM, or e.g., greater than about 0.2, about 0.3, about 0.4, about 0.5, about 0.6, about 0.7, about 0.8, about 0.9, about 1, about 1.1, about 1.2, about 1.3, about 1.4, about 1.5, about 2, about 3, about 4, about 5, about 6, about 7, about 8, about 9, about 10, about 11, about 12, about 13, about 14, about 15, about 16, about 17, about 18, or about 20 nM, e.g., as determined by yeast surface display.

In an embodiment, the IL-2 variant binds to CD122/CD132 heterodimer (e.g., human CD122/CD132 heterodimer) with low affinity, e.g., with a dissociation constant (KD) of about 0.2-300 nM, e.g., about 0.2 nM, about 0.5 nM, about 1 nM, about 2 nM, about 5 nM, about 10 nM, about 15 nM, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or about 300 nM, or e.g., about 0.5 to about 15 nM, about 1 to about 10 nM, about 2 to about 5 nM, about 0.2 nM to about 0.5 nM, about 0.5 nM to about 1 nM, about 1 to about 2 nM, about 2 nM to about 5 nM, about 5 nM to about 10 nM, about 10 nM to about 15 nM, about 15 nM to about 20 nM, about 20 nM to about 25 nM, about 25 to about 30 nM, about 30 nM to about 40 nM, about 40 nM to about 50 nM, about 50 to about 60 nM, about 60 to about 70 nM, about 70 nM to about 80 nM, about 80 nM to about 90 nM, about 90 nM to about 100 nM, about 100 nM to about 110 nM, about 110 nM to about 120 nM, about 120 nM to about 130 nM, about 130 nM to about 140 nM, about 140 nM to about 150 nM, about 150 nM to about 160 nM, about 160 nM to about 170 nM, about 170 nM to about 180 nM, about 180 nM to about 190 nM, about 190 nM to about 200 nM, about 200 nM to about 210 nM, about 210 nM to about 220 nM, about 220 nM to about 230 nM, about 230 nM to about 240 nM, about 240 nM to about 250 nM, about 250 nM to 30 about 260 nM, about 260 nM to about 270 nM, about 270 nM to about 280 nM, about 280 nM to about 290 nM, or about 290 nM to about 300 nM, or e.g., greater than about 0.2, about 0.5, about 1, about 2, about 5, about 10, about 15, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM about 160 nM, about 170 nM, about 180 nM, about about 260 nM, about 270 nM, about 280 nM, about 290 nM, or greater than about 300 nM, e.g., as determined by surface plasmon resonance (e.g. Biacore) and/or biolayer interferometry (e.g. Octet binding).

In an embodiment, the IL-2 variant has altered (e.g., enhanced, increased, and/or selective) binding to Tregs in vitro and/or in vivo, relative to a wild-type IL-2 or a reference IL-2 variant. In an embodiment, the IL-2 variant has enhanced or increased binding to Tregs relative to a wild-type IL-2. In an embodiment, the IL-2 variant has selective binding to Tregs relative to IL-2 (e.g., wild type human IL-2). In an embodiment, the IL-2 variant has enhanced or increased binding to Tregs relative to a reference IL-2 variant. In an embodiment, the IL-2 variant has selective binding to Tregs relative to a reference IL-2 variant. In an embodiment, the binding to Tregs is increased by about 1%, 5%, 10%, 20%, 30%, 40%, 50%, 60%, 70%, 80%, 90%, 95%, or about 100%, or more. In an embodiment, the binding to Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has altered (e.g., enhanced, increased, and/or selective) activation of the IL-2 signaling pathway in Tregs in vitro and/or in vivo, relative to a wild-type IL-2 or a reference IL-2 variant. In an embodiment, the IL-2 variant has enhanced or increased activation of the IL-2 signaling pathway in Tregs relative to a wild-type IL-2. In an embodiment, the IL-2 variant has selective activation of the IL-2 signaling pathway in Tregs relative to a wild-type IL-2. In an embodiment, the IL-2 variant has enhanced or increased activation of the IL-2 signaling pathway in Tregs relative to a reference IL-2 variant. In an embodiment, the IL-2 variant has selective activation of the IL-2 signaling pathway in Tregs relative to a reference IL-2 variant. In an embodiment, the activation of the IL-2 signaling pathway in Tregs is increased by about 1%, 5%, 10%, 20%, 30%, 40%, 50%, 60%, 70%, 80%, 90%, 95%, or about 100%, or more. In an embodiment, the activation of the IL-2 signaling pathway in Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant selectively activates IL-2 signaling in T regulatory cells in vitro and/or in vivo, e.g., having an T helper EC50/Treg EC50 ratio greater than about 1, about 2, about 3, about 4, about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 150, 200, 250, 300, 350, 400, 450, 500, 600, 700, 800, 900, 1000, 1500, 2000, 2500, or about 3000 or more relative to an IL-2 agent comprising a wild-type IL-2 or an IL-2 agent comprising a reference IL-2 variant e.g., as determined flow cytometry.

In an embodiment, the IL-2 variant selectively activates IL-2 signaling in T regulatory cells in vitro and/or in vivo, e.g., having an NK cell EC50/Treg EC50 ratio greater than e.g., about 1, about 2, about 3, about 4, about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 150, 200, 250, 300, 350, 400, 450, 500, 600, 700, 800, 900, 1000, 1500, 2000, 2500, or about 3000 or more, or e.g., greater than 1 and about 1 to 2, about 2 to 3, about 3 to 4, about 4 to 5, greater than 1 and about 1 to 10, greater than 1 and about 1 to 20, greater than 1 and about 1 to 30, greater than 1 and about 1 to 40, greater than 1 and about 1 to 50, about 2 to 10, about 2 to 20, about 2 to 30, about 2 to 40, 2 to 50, about 5 to 10, about 5 to 20, about 5 to 30, about 5 to 40, about 5 to 50, about 10 to 20, about 10 to 30, about 10 to 40 about 10 to 50, about 20 to 40, about 20 to 50, about 50 to 100, about 100 to 200, about 200 to 500, about 500 to 1000, about 1000 to 2000, or about 1000 to 3000, relative to an IL-2 agent comprising a wild-type IL-2 or an IL-2 agent comprising a reference IL-2 variant e.g., as determined flow cytometry.

In an embodiment, the IL-2 variant has altered (e.g., enhanced, increased, and/or selective) ability to induce or promote Treg expansion, activity, survival, and/or proliferation in vitro and/or in vivo, relative to a wild-type IL-2 or a reference IL-2 variant. In an embodiment, the IL-2 variant has enhanced or increased ability to induce or promote Treg expansion, activity, survival, and/or proliferation relative to a wild-type IL-2. In an embodiment, the IL-2 variant has selective ability to induce or promote Treg expansion, activity, survival, and/or proliferation relative to a wild-type IL-2. In an embodiment, the IL-2 variant has enhanced or increased ability to induce or promote Treg expansion, activity, survival, and/or proliferation relative to a reference IL-2 variant. In an embodiment, the IL-2 variant has selective ability to induce or promote Treg expansion, activity, survival, and/or proliferation relative to a reference IL-2 variant. In an embodiment, the ability to induce or promote Treg expansion, activity, survival, and/or proliferation is increased by about 1%, 5%, 10%, 20%, 30%, 40%, 50%, 60%, 70%, 80%, 90%, 95%, or about 100%, or more. In an embodiment, the ability to induce or promote Treg expansion, activity, survival, and/or proliferation is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has enhanced or increased potency and/or ability to induce or promote T regulatory cell activity, e.g., having an EC50 for Tregs that is lower by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined flow cytometry.

In an embodiment, the IL-2 variant has reduced or decreased potency and/or ability to induce or promote T regulatory cell activity, e.g., having an EC50 for Tregs that is higher by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, about 50-fold, about 100-fold, about 200-fold, about 500-fold, about 1000-fold, about 2000-fold, about 5000-fold, about 10,000, about 15,000-fold, or about 20,000-fold or more e.g., relative to an IL-2 agent comprising a wild-type IL-2 or an IL-2 agent comprising a reference IL-2 variant e.g., as determined flow cytometry.

In an embodiment, the T helper cell described herein is a CD45+CD3+CD4+Foxp3− cell, e.g., determined by flow cytometry. In an embodiment, the Treg described herein is CD45+CD3+CD4+Foxp3+ cell, e.g., determined by flow cytometry. In an embodiment, the NK cell described herein is a CD45+CD3− cell that is CD56+ and/or CD16+, e.g., determined by flow cytometry. In an embodiment, the NK cell described herein is a CD45+CD3−CD56+ cell, e.g., determined by flow cytometry.

In an embodiment, the IL-2 variant has one or more of the same, or substantially the same, structural and/or functional properties, as a wild-type IL-2 or a reference IL-2 variant.

In an embodiment, the reference IL-2 variant comprises an amino acid sequence that has about 75%, 80%, 85%, 90%, 91%, 92%, 93%, 94%, 95%, 96%, 97%, 98%, 99%, or more sequence identity to an IL-2 variant described herein. In an embodiment, the reference IL-2 variant comprises the amino acid sequence of SEQ ID NO: 1 (IL-2 C125S). In an embodiment, the IL-2 variant comprises an amino acid sequence that is at least 80%, 85%, 90%, 95%, or 98% identical to the amino acid sequence of SEQ ID NO: 1 and comprises one or more (2, 3, 4, 5, 6, 7, 8, 9, 10, or more) amino acid alterations (e.g., substitutions) described herein.

For purposes of this disclosure, IL-2 variant position numbering begins at the first amino acid following the signal peptide of the exemplary wild type (WT) human IL-2 polypeptide: MYRMQLLSCIALSLALVTNS/A1/P2/T3/ S4/S5/S6/T7/K8/K9/T10/Q11/L12/Q13/L14/E15/H16/L1 7/L18/L19/D20/L21/Q22/M23/I24/L25/N26/G27/I28/N29/ N30/Y31/K32/N33/P34/K35/L36/T37/R38/M39/L40/T41/ F42/K43/F44/Y45/M46/P47/K48/K49/A50/T51/E52/L53/ K54/H55/L56/Q57/C58/L59/E60/E61/E62/L63/K64/P65/ L66/E67/E68/V69/L70/N71/L72/A73/Q74/S75/K76/N77/ F78/H79/L80/R81/P82/R83/D84/L85/I86/S87/N88/I89/ N90/V91/I92/V93/L94/E95/L96/K97/G98/S99/E100/T101/ T102/F103/M104/C105/E106/Y107/A108/D109/E110/ T111/A112/T113/I114/V115/E116/F117/L118/N119/R120/ W121/I122/T123/F124/C125/Q126/S127/I128/I129/S130/ T131/L132/T133 (SEQ ID NO: 360; Uniprot P60568; signal peptide underlined). The corresponding amino acid sequence without the signal peptide is shown as SEQ ID NO: 1031.

In an embodiment, the IL-2 agent comprises amino acid alteration(s) (e.g., substitution(s)) at position(s) corresponding to human IL-2 (e.g., comprising the amino acid sequence of SEQ ID NO: 1031).

In an embodiment, the IL-2 variant comprises the amino acid sequence of A1/P2/X3/S4/S5/S6/T7/K8/K9/T10/Q11/ L12/Q13/L14/E15/X16/L17/L18/L19/D20/L21/Q22/M23/ I2 4/L25/N26/G27/X28/N29/N30/Y31/K32/N33/P34/X35/ L36/T37/X38/M39/L40/T41/X42/K43/F44/Y 45/M46/P47/ K48/K49/A50/T51/E52/L53/K54/H55/L56/Q57/C58/L59/ E60/E61/E62/L63/K64/P65/L 66/E67/X68/X69/L70/N71/ L72/A73/X74/S75/K76/N77/F78/H79/L80/R81/P82/R83/ X84/L85/I86/X8 7/X88/I89/N90/V91/X92/V93/L94/E95/ L96/K97/G98/S99/E100/T101/T102/F103/M104/C105/ E106/Y107/A108/D109/E110/T111/A112/T113/I114/V115/ E116/F117/L118/N119/R120/W121/I122/T123/F124/X125/ X126/S127/I128/I129/S130/T131/L132/T133 (SEQ ID NO: 1032), wherein: X3 is T or A; X16 is H, L or N; X28 is I, T or F; X35 is K or E; X38 is R, E, N or Q; X42 is F, A, K or Q; X68 is E, Q or N; X69 is V or A; X74 is Q or P; X84 is D or V; X87 is S or R; X88 is N, D, L or S; X92 is I or S; X125 is C or S; and X126 is Q, K, R or T, provided that the IL-2 variant does not comprise the amino acid sequence of SEQ ID NO: 1 or 1031. In an embodiment, the IL-2 variant comprises, or consists of, an IL-2 variant amino acid sequence described herein.

In an embodiment, the IL-2 variant comprises an amino acid alteration (e.g., substitution) at one or more (e.g., 2, 3, 4, 5, 6, 7, 8, 9, 10, 11, 12, 13, 14, or all) of positions, as described herein. In an embodiment, the IL-2 variant comprises an amino acid alteration (e.g., substitution) at one or more (e.g., 2, 3, 4, 5, 6, 7, 8, 9, 10, 11, 12, 13, 14, or all) of positions chosen from T3, H16, I28, K35, R38, F42, E68, V69, Q74, D84, S87, N88, I92, C125, or Q126.

In an embodiment, the IL-2 variant comprises an amino acid alteration (e.g., substitution) at position T3. In an embodiment, the IL-2 variant comprises an amino acid alteration (e.g., substitution) at position H16. In an embodiment, the IL-2 variant comprises an amino acid alteration (e.g., substitution) at position I28. In an embodiment, the IL-2 variant comprises an amino acid alteration (e.g., substitution) at position K35. In an embodiment, the IL-2 variant comprises an amino acid alteration (e.g., substitution) at position R38. In an embodiment, the IL-2 variant comprises an amino acid alteration (e.g., substitution) at position F42. In an embodiment, the IL-2 variant comprises an amino acid alteration (e.g., substitution) at position E68. In an embodiment, the IL-2 variant comprises an amino acid alteration (e.g., substitution) at position V69. In an embodiment, the IL-2 variant comprises an amino acid alteration (e.g., substitution) at position Q74. In an embodiment, the IL-2 variant comprises an amino acid alteration (e.g., substitution) at position D84. In an embodiment, the IL-2 variant comprises an amino acid alteration (e.g., substitution) at position S87. In an embodiment, the IL-2 variant comprises an amino acid alteration (e.g., substitution) at position N88. In an embodiment, the IL-2 variant comprises an amino acid alteration (e.g., substitution) at position I92. In an embodiment, the IL-2 variant comprises an amino acid alteration (e.g., substitution) at position C125. In an embodiment, the IL-2 variant comprises an amino acid alteration (e.g., substitution) at position Q126.

In an embodiment, the IL-2 variant comprises an amino acid alteration (e.g., substitution) at position V69, Q74, or a combination thereof. In an embodiment, the IL-2 variant comprises an amino acid alteration (e.g., substitution) at positions V69 and Q74. In an embodiment, the IL-2 variant comprises the amino acid substitution V69A. In an embodiment, the IL-2 variant comprises the amino acid substitution Q74P.

In an embodiment, the IL-2 variant comprises an amino acid alteration (e.g., substitution) at position H16, I92, D84, or a combination thereof. In an embodiment, the IL-2 variant comprises an amino acid alteration (e.g., substitution) at position H16, optionally wherein the amino acid substitution is H16N, H16L, or H16D. In an embodiment, the IL-2 variant comprises the amino acid substitution H16N. In an embodiment, the IL-2 variant comprises the amino acid substitution H16L. In an embodiment, the IL-2 variant comprises the amino acid substitution H16D.

In an embodiment, the IL-2 variant comprises an amino acid alteration (e.g., substitution) at position at I92, optionally wherein the amino acid substitution is I92S. In an embodiment, the IL-2 variant comprises the amino acid substitution I92S.

In an embodiment, the IL-2 variant comprises an amino acid alteration (e.g., substitution) at position D84, optionally wherein the amino acid substitution is D84V. In an embodiment, the IL-2 variant comprises the amino acid substitution is D84V.

In an embodiment, the IL-2 variant comprises an amino acid alteration (e.g., substitution) at position K35, R38, F42, E68, or a combination thereof. In an embodiment, the IL-2 variant comprises an amino acid alteration (e.g., substitution) at position K35, optionally wherein the amino acid substitution is K35E. In an embodiment, IL-2 variant comprises the amino acid substitution K35E.

In an embodiment, the IL-2 variant comprises an amino acid alteration (e.g., substitution) at position R38, optionally wherein the amino acid substitution is R38E, R38N or R38Q. In an embodiment, the IL-2 variant comprises the amino acid substitution R38N. In an embodiment, the IL-2 variant comprises the amino acid substitution R38Q.

In an embodiment, the IL-2 variant comprises an amino acid alteration (e.g., substitution) at position F42, optionally wherein the amino acid substitution is F42K or F42Q. In an embodiment, the IL-2 variant comprises the amino acid substitution F42K. In an embodiment, the IL-2 variant comprises the amino acid substitution F42Q.

In an embodiment, the IL-2 variant comprises an amino acid alteration (e.g., substitution): (i) at (a) positions V69 and Q74, (b) position K35, or (c) positions V69, Q74, and K35; and (ii) at one, two, or all of positions H16, I92, or D84. In an embodiment, the IL-2 variant further comprises an amino acid alteration (e.g., substitution) at one, two, or all of positions R38, F42, or E68.

In an embodiment, the IL-2 variant comprises an amino acid alteration (e.g., substitution): (i) at (a) positions V69 and Q74, (b) position K35, or (c) positions V69, Q74, and K35; and (ii) at (a) one, two, or all of positions H16, I92, or D84; or (b) one, two, or all of positions R38, F42, or E68.

In an embodiment, the IL-2 variant comprises an amino acid alteration (e.g., substitution): (i) at (a) positions V69 and Q74, (b) position K35, or (c) positions V69, Q74, and K35; and (ii) at (a) one, two, or all of positions H16, I92, or D84; and (b) one, two, or all of positions R38, F42, or E68.

In an embodiment, the IL-2 variant comprises an amino acid alteration (e.g., substitution) at position V69, Q74, and H16, optionally wherein the amino acid substitution is V69A, Q74P, and H16N or H16L, respectively. In an embodiment, the IL-2 variant comprises the amino acid substitutions V69A, Q74P, and H16N or H16L. In an embodiment, the IL-2 variant comprises the amino acid substitutions V69A, Q74P, and H16N. In an embodiment, the IL-2 variant comprises the amino acid substitutions V69A, Q74P, and H16L.

In an embodiment, the IL-2 variant comprises an amino acid alteration (e.g., substitution) at position V69, Q74, and I92, optionally wherein the amino acid substitution is V69A, Q74P, and I92S, respectively. In an embodiment, the IL-2 variant comprises the amino acid substitutions V69A, Q74P, and I92S.

In an embodiment, the IL-2 variant comprises an amino acid alteration (e.g., substitution) at position V69, Q74, and D84, optionally wherein the amino acid substitution is V69A, Q74P, and D84V, respectively. In an embodiment, the IL-2 variant comprises the amino acid substitutions V69A, Q74P, and D84V.

In an embodiment, the IL-2 variant comprises an amino acid alteration (e.g., substitution) at position V69, Q74, and R38, optionally wherein the amino acid substitution is V69A, Q74P, and R38Q, respectively. In an embodiment, the IL-2 variant comprises the amino acid substitutions V69A, Q74P, and R38Q.

In an embodiment, the IL-2 variant comprises an amino acid alteration (e.g., substitution) at position V69, Q74, and F42, optionally wherein the amino acid substitution is V69A, Q74P, and F42Q, respectively. In an embodiment, the IL-2 variant comprises the amino acid substitutions V69A, Q74P, and F42Q.

In an embodiment, the IL-2 variant comprises an amino acid alteration (e.g., substitution) at position V69, Q74, and R38, optionally wherein the amino acid substitution is V69A, Q74P, and R38N, respectively. In an embodiment, the IL-2 variant comprises the amino acid substitutions V69A, Q74P, and R38N.

In an embodiment, the IL-2 variant comprises an amino acid alteration (e.g., substitution) at position V69, Q74, and R38, optionally wherein the amino acid substitution is V69A, Q74P, and R38E, respectively. In an embodiment, the IL-2 variant comprises the amino acid substitution V69A, Q74P, and R38E.

In an embodiment, the IL-2 variant comprises an amino acid alteration (e.g., substitution) at position V69, Q74, K35, and H16, optionally wherein the amino acid substitution is V69A, Q74P, K35E, and H16N, respectively. In an embodiment, the IL-2 variant comprises the amino acid substitutions V69A, Q74P, K35E, and H16N.

In an embodiment, the IL-2 variant comprises an amino acid alteration (e.g., substitution) at position V69, Q74, K35, H16, and R38, optionally wherein the amino acid substitution is V69A, Q74P, K35E, H16N, and R38N, respectively. In an embodiment, the IL-2 variant comprises the amino acid substitutions V69A, Q74P, K35E, H16N, and R38N.

In an embodiment, the IL-2 variant comprises an amino acid alteration (e.g., substitution) at position V69, Q74, H16, and R38, optionally wherein the amino acid substitution is V69A, Q74P, H16N, and R38N or R38Q, respectively. In an embodiment, the IL-2 variant comprises the amino acid substitutions V69A, Q74P, H16N, and R38N or R38Q. In an embodiment, the IL-2 variant comprises the amino acid substitutions V69A, Q74P, H16N, and R38N. In an embodiment, the IL-2 variant comprises the amino acid substitutions V69A, Q74P, H16N, and R38Q.

In an embodiment, the IL-2 variant comprises an amino acid alteration (e.g., substitution) at position I28, E68, S87, N88, Q126, or a combination thereof.

In an embodiment, the IL-2 variant comprises an amino acid alteration (e.g., substitution) at position I28, optionally wherein the amino acid substitution is I28T or I28F. In an embodiment, the IL-2 variant comprises the amino acid substitution I28T. In an embodiment, the IL-2 variant comprises the amino acid substitution I28F.

In an embodiment, the IL-2 variant comprises an amino acid alteration (e.g., substitution) at position E68, optionally wherein the amino acid substitution is E68Q or E68N. In an embodiment, the IL-2 variant comprises the amino acid substitution E68Q. In an embodiment, the IL-2 variant comprises the amino acid substitution E68N.

In an embodiment, the IL-2 variant comprises an amino acid alteration (e.g., substitution) at position S87, optionally wherein the amino acid substitution is S87R. In an embodiment, the IL-2 variant comprises the amino acid substitution S87R.

In an embodiment, the IL-2 variant comprises an amino acid alteration (e.g., substitution) at position N88, optionally wherein the amino acid substitution is N88S, N88L, or N88D. In an embodiment, the IL-2 variant comprises the amino acid substitution N88S, N88L, or N88D. In an embodiment, the IL-2 variant comprises the amino acid substitution N88S. In an embodiment, the IL-2 variant comprises the amino acid substitution N88L. In an embodiment, the IL-2 variant comprises the amino acid substitution N88D.

In an embodiment, the IL-2 variant comprises an amino acid alteration (e.g., substitution) at position Q126, optionally wherein the amino acid substitution is Q126T, Q126K, or Q126R. In an embodiment, the IL-2 variant comprises the amino acid substitution Q126T, Q126K, or Q126R. In an embodiment, the IL-2 variant comprises the amino acid substitution Q126T, Q126K, or Q126R. In an embodiment, the IL-2 variant comprises the amino acid substitution Q126T. In an embodiment, the IL-2 variant comprises the amino acid substitution Q126K. In an embodiment, the IL-2 variant comprises the amino acid substitution Q126R.

In an embodiment, the IL-2 variant comprises an amino acid alteration (e.g., substitution) at position C125, optionally wherein the amino acid substitution is C125S. In an embodiment, the IL-2 variant comprises the amino acid substitution C125S.

In an embodiment, the IL-2 variant comprises an amino acid alteration (e.g., substitution) at position T3, optionally wherein the amino acid substitution is T3A. In an embodiment, the IL-2 variant comprises the amino acid substitution T3A.

In an embodiment, the IL-2 variant comprises an amino acid alteration (e.g., substitution) at position V69, Q74, and C125, optionally wherein the amino acid substitution is V69A, Q74P, and C125S, respectively. In an embodiment, the IL-2 variant comprises the amino acid substitutions V69A, Q74P, and C125S.

In an embodiment, the IL-2 variant comprises an amino acid alteration (e.g., substitution) at position T3, H16, I92, or a combination thereof, optionally wherein the amino acid substitution is T3A, H16N, and I92S, respectively.

In an embodiment, the IL-2 variant comprises an amino acid alteration (e.g., substitution) at position H16, V69, Q74, and C125, optionally wherein the amino acid substitution is H16N, V69A, Q74P, and C125S, respectively. In an embodiment, the IL-2 variant comprises the amino acid substitutions H16N, V69A, Q74P, and C125S.

In an embodiment, the IL-2 variant comprises an amino acid alteration (e.g., substitution) at position H16, V69, Q74, and C125, optionally wherein the amino acid substitution is H16L, V69A, Q74P, and C125S, respectively. In an embodiment, the IL-2 variant comprises the amino acid substitutions H16L, V69A, Q74P, and C125S.

In an embodiment, the IL-2 variant comprises an amino acid alteration (e.g., substitution) at position H16, V69, Q74, I92, and C125, optionally wherein the amino acid substitution is H16L, V69A, Q74P, I92S, and C125S, respectively. In an embodiment, the IL-2 variant comprises the amino acid substitutions H16L, V69A, Q74P, I92S, and C125S.

In an embodiment, the IL-2 variant comprises an amino acid alteration (e.g., substitution) at position T3, V69, Q74, and C125, optionally wherein the amino acid substitution is T3A, V69A, Q74P, and C125S, respectively. In an embodiment, the IL-2 variant comprises the amino acid substitutions T3A, V69A, Q74P, and C125S.

In an embodiment, the IL-2 variant comprises an amino acid alteration (e.g., substitution) at position T3, H16, V69, Q74, and C125, optionally wherein the amino acid substitution is T3A, H16N or H16L, V69A, Q74P, and C125S, respectively. In an embodiment, the IL-2 variant comprises the amino acid substitutions T3A, H16N, V69A, Q74P, and C125S. In an embodiment, the IL-2 variant comprises the amino acid substitutions T3A, H16L, V69A, Q74P, and C125S.

In an embodiment, the IL-2 variant comprises an amino acid alteration (e.g., substitution) at position T3, V69, Q74, I92, and C125, optionally wherein the amino acid substitution is T3A, V69A, Q74P, I92S, and C125S, respectively. In an embodiment, the IL-2 variant comprises the amino acid substitutions T3A, V69A, Q74P, I92S, and C125S. In an embodiment, the IL-2 variant comprises the amino acid substitutions T3A, V69A, Q74P, I92S, and C125S.

In an embodiment, the IL-2 variant comprises an amino acid alteration (e.g., substitution) at position H16, K35, V69 and Q74, optionally wherein the amino acid substitution is H16L, K35E, V69A, and Q74P, respectively. In an embodiment, the IL-2 variant comprises the amino acid substitutions H16L, K35E, V69A, and Q74P.

In an embodiment, the IL-2 variant comprises an amino acid alteration (e.g., substitution) at position H16, R38, V69A, and Q74P, optionally wherein the amino acid substitution is H16L, R38Q, V69A, and Q74P, respectively. In an embodiment, the IL-2 variant comprises the amino acid substitutions H16L, R38Q, V69A, and Q74P.

In an embodiment, the IL-2 variant comprises amino acid substitutions H16L, V69A, Q74P, and C125S. In an embodiment, the IL-2 variant comprises amino acid substitutions H16N, V69A, Q74P, and C125S.

There are various technical effects associated with the presence of the particular sets of mutations described herein, for example, a set of mutations comprising an amino acid substitution at position H16, in combination with amino acid substitutions at positions V69, Q74, and C125 (e.g., H16L, V69A, Q74P, and C125S). Without wishing to be bound by theory, it is believed that in an embodiment, an IL-2 variant comprising the aforesaid mutations also has reduced binding affinity for CD122 and/or CD132, which increases the potency and selectivity of the IL-2 variant for regulatory T cells (Treg) compared to other T cell types. Without wishing to be bound by theory, it is also believed that in an embodiment, an IL-2 variant comprising the aforesaid mutations is significantly stable, e.g., due to the presence of stabilizing V69A and Q74P mutations. For example, it was unexpected discovered that the V69A and Q74P substitutions do not substantially increase the binding affinity of the IL-2 variant for CD25, but rather stabilize the IL-2 variant in an active conformation sufficient for binding to CD25. Therefore, an IL-2 variant comprising these mutations selectively activates regulatory T cells (Treg) and is significantly stable. Without wishing to be bound by theory, it is further believed that in an embodiment, an IL-2 variant comprising the aforesaid mutations has reduced or decreased binding capacity and/or binding affinity for CD25, which improves the lifetime of the IL-2 variant. Without wishing to be bound by theory, it is also believed that in an embodiment, an IL-2 variant comprising these mutations does not substantially promote expansion, activation, survival, and/or proliferation of T effector cells and/or natural killer (NK) cells in vitro and/or in vivo. Without wishing to be bound by theory, it is further believed that in an embodiment, an IL-2 variant comprising the aforesaid mutations has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 variant comprising these mutations particularly suitable for treating disorders and conditions arising from abnormal immune responses.

Thus, in an embodiment, an IL-2 variant (e.g., IL-2 variant or IL-2 fusion protein) comprising an amino acid substitution at position H16 in combination with amino acid substitutions at positions V69, Q74, and C125 (e.g., H16L, V69A, Q74P, and C125S), has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased binding capacity and/or binding affinity for human CD25 in vitro and/or in vivo; (vi) selective binding to regulatory T cells (e.g. Foxp3⁺ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the IL-2 variant comprises, or consists of, an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 variant comprises, or consists of, the amino acid sequence of SEQ ID NO: 4, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 5, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 11, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 1000, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 1001, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 variant comprises, or consists of, the amino acid sequence of any of SEQ ID NOs: 4, 5, 11, 1000, 1001, or 1002, or a functional fragment thereof. In an embodiment, the IL-2 variant comprises, or consists of, the amino acid sequence of SEQ ID NO: 4 or 5, or a functional fragment thereof. In an embodiment, the IL-2 variant comprises, or consists of, the amino acid sequence of SEQ ID NO: 4, or a functional fragment thereof. In an embodiment, the IL-2 variant comprises, or consists of, the amino acid sequence of SEQ ID NO: 5, or a functional fragment thereof. In an embodiment, the IL-2 variant comprises, or consists of, the amino acid sequence of SEQ ID NO: 11, or a functional fragment thereof. In an embodiment, the IL-2 variant comprises, or consists of, the amino acid sequence of SEQ ID NO: 1000, or a functional fragment thereof. In an embodiment, the IL-2 variant comprises, or consists of, the amino acid sequence of SEQ ID NO: 1001, or a functional fragment thereof. In an embodiment, the IL-2 variant comprises, or consists of, the amino acid sequence of SEQ ID NO: 1002, or a functional fragment thereof.

Without wishing to be bound by theory, it is believed that in an embodiment, an IL-2 variant comprising, or consisting of, the amino acid sequence of SEQ ID NO: 5, or a functional fragment thereof, can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 variant comprising, or consisting of, the amino acid sequence of SEQ ID NO: 5 particularly suitable for treating disorders and conditions arising from abnormal immune responses.

Thus, in an embodiment, an IL-2 variant comprising, or consisting of, the amino acid sequence SEQ ID NO: 5, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto, has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased or substantially unchanged binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

As described further herein, the disclosure provides IL-2 fusion proteins, IL-2 complexes, and IL-2 conjugates comprising an IL-2 variant described herein. In an embodiment, one or more different and/or improved properties ascribed to an IL-2 variant described herein is maintained, transferred, or imparted to the IL-2 fusion protein, IL-2 complex, or IL-2. For the purposes of the present disclosure, the terms "IL-2 variant" and "IL-2 mutein" may be used interchangeably herein.

In an embodiment, the IL-2 variant comprises a polypeptide (sometime referred to herein as "IL-2 variant polypeptide"). This disclosure provides an isolated nucleic acid molecule encoding an IL-2 variant described herein, and vectors and host cells thereof. The nucleic acid molecule includes, but is not limited to, RNA, genomic DNA and cDNA.

IL-2 Fusion Proteins

In an embodiment, the IL-2 agent comprises an IL-2 fusion protein, e.g., an IL-2 fusion protein described herein.

In an embodiment, the IL-2 fusion protein comprises an IL-2 variant, e.g., an IL-2 variant described herein. In an embodiment, the IL-2 fusion protein comprises one or more amino acid alterations (e.g., substitutions) described in Table 9. In an embodiment, the IL-2 fusion protein comprises an amino acid sequence described in Table 9, or a functional fragment thereof. In an embodiment, the IL-2 variant is encoded by a nucleic acid comprising a nucleotide sequence described herein, e.g., in Table 10.

Without wishing to be bound by theory, it is believed that in an embodiment, the IL-2 fusion proteins described herein, which have reduced human CD25 and/or reduced human CD122/CD132 binding affinity relative to a IL-2 fusion protein comprising a wild-type human IL-2 or a reference IL-2 fusion protein, can have improved potency and/or selectivity for binding to and activating regulatory T cells (Tregs) than IL-2 fusion proteins comprising a wild-type human IL-2 or other IL-2 fusion protein.

In an embodiment, the IL-2 fusion protein has one or more (e.g., 2, 3, 4, 5, 6, 7, 8, 9, 10, 11, 12, or more) properties described herein, e.g., different and/or improved properties, relative to an IL-2 fusion protein comprising a wild-type IL-2 or a reference IL-2 fusion protein. In an embodiment, the IL-2 fusion protein comprises one or more (e.g., 2, 3, 4, 5, 6, 7, 8, 9, 10, or more) amino acid alterations (e.g., substitutions) that provide different and/or improved properties, relative to an IL-2 fusion protein comprising a wild-type IL-2 or a reference IL-2 fusion protein. In an embodiment, the IL-2 fusion protein has one or more (e.g., 2, 3, 4, 5, 6, 7, 8, 9, 10, 11, 12, or all) of the following different and/or improved properties (e.g., as determined by an assay described herein), relative to an IL-2 fusion protein comprising a wild-type IL-2 or a reference IL-2 fusion protein:

i) altered (e.g., enhanced or increased) expression in vitro and/or in vivo;

ii) altered (e.g., reduced or decreased) aggregation in vitro and/or in vivo;

iii) altered (e.g., enhanced or increased) stability in vitro and/or in vivo;

iv) altered (e.g., enhanced or increased) half-life in vitro and/or in vivo;

v) altered (e.g., reduced or decreased) turnover and/or clearance in vivo;

vi) altered (e.g., reduced or decreased) susceptibility to proteolysis in vitro and/or in vivo;

vii) altered (e.g., enhanced or increased) resistance to proteolysis in vitro and/or in vivo;

viii) altered (e.g., reduced or decreased) binding capacity and/or binding affinity for human CD25 in vitro and/or in vivo;

ix) altered (e.g., reduced or decreased) binding capacity and/or binding affinity for human CD132 in vitro and/or in vivo;

x) altered (e.g., reduced or decreased) binding capacity and/or binding affinity for the dimeric IL-2 receptor comprising human CD122 and human CD132 in vitro and/or in vivo;

xi) altered (e.g., enhanced, increased, reduced, decreased, and/or selective) binding to Tregs in vitro and/or in vivo;

xii) altered (e.g., enhanced, increased, reduced, decreased, and/or selective) activation of the IL-2 signaling pathway in Tregs in vitro and/or in vivo; or xiii) altered (e.g., enhanced, increased, reduced, decreased, and/or selective) ability to induce or promote Treg expansion, activity, survival, and/or proliferation in vitro and/or in vivo.

In an embodiment, the IL-2 fusion protein has altered (e.g., enhanced or increased) expression in vitro and/or in vivo, relative to an IL-2 fusion protein comprising a wild-type IL-2 or a reference IL-2 fusion protein. In an embodiment, the IL-2 fusion protein has enhanced or increased expression (e.g., in a bacterial or mammalian cell) relative to an IL-2 fusion protein comprising a wild-type IL-2. In an embodiment, the IL-2 fusion protein has enhanced or increased expression (e.g., in bacterial or mammalian cell) relative to a reference IL-2 fusion protein. In an embodiment, the expression of the IL-2 fusion protein is increased by about 1%, 5%, 10%, 20%, 30%, 40%, 50%, 60%, 70%, 80%, 90%, 95%, or about 100%, or more. In an embodiment, the expression of the IL-2 fusion protein is increased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein expresses at a higher or increased level in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more e.g., relative to an IL-2 fusion protein comprising a wild-type IL-2 or a reference IL-2 fusion protein e.g., as determined by an assay of protein concentration. In an embodiment, the IL-2 fusion protein expresses at a higher or increased level, e.g., increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined by an assay of protein concentration.

In an embodiment, the IL-2 fusion protein has altered (e.g., reduced or decreased) aggregation in vitro and/or in vivo, relative to an IL-2 fusion protein comprising a wild-type IL-2 or a reference IL-2 fusion protein. In an embodiment, the IL-2 fusion protein has reduced or decreased aggregation relative to a wild type IL-2. In an embodiment, the IL-2 fusion protein has reduced or decreased aggregation relative to a reference IL-2 fusion protein. In an embodiment, the aggregation of the IL-2 fusion protein is decreased by about 1%, 5%, 10%, 20%, 30%, 40%, 50%, 60%, 70%, 80%, 90%, 95%, or about 100%, or more. In an embodiment, the aggregation of the IL-2 fusion protein is decreased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein aggregates at lower or decreased level in vitro and/or in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more e.g., relative to an IL-2 fusion protein comprising a wild-type IL-2 or a reference IL-2 fusion protein e.g., as determined by melting temperature analysis (e.g., using fluorimetry), dynamic light scattering, and/or size-exclusion chromatography. In an embodiment, the IL-2 fusion protein aggregates at lower or decreased level, e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined by melting temperature analysis (e.g., using fluorimetry), dynamic light scattering, and/or size-exclusion chromatography.

In an embodiment, the IL-2 fusion protein has altered (e.g., enhanced or increased) stability in vitro and/or in vivo, relative to an IL-2 fusion protein comprising a wild-type IL-2 or a reference IL-2 fusion protein. In an embodiment, the IL-2 fusion protein has enhanced or increased stability relative to an IL-2 fusion protein comprising a wild-type IL-2. In an embodiment, the IL-2 fusion protein has enhanced or increased stability relative to a reference IL-2 fusion protein. In an embodiment, the stability of the IL-2 fusion protein is increased by about 1%, 5%, 10%, 20%, 30%, 40%, 50%, 60%, 70%, 80%, 90%, 95%, or about 100%, or more. In an embodiment, the stability of the IL-2 fusion protein is increased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein has enhanced or increased stability in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein, e.g., as determined by yeast surface display, circular dichroism or related spectroscopic techniques, and/or melting temperature analysis (e.g., using fluorimetry).

In an embodiment, the IL-2 fusion protein has altered (e.g., enhanced or increased) half-life in vitro and/or in vivo, relative to an IL-2 fusion protein comprising a wild-type IL-2 or a reference IL-2 fusion protein. In an embodiment, the IL-2 fusion protein has enhanced or increased half-life relative to an IL-2 fusion protein comprising a wild-type IL-2. In an embodiment, the IL-2 fusion protein has enhanced or increased half-life relative to a reference IL-2 fusion protein. In an embodiment, the half-life of the IL-2 fusion protein is increased by about 1%, 5%, 10%, 20%, 30%, 40%, 50%, 60%, 70%, 80%, 90%, 95%, or about 100%, or more. In an embodiment, the half-life of the IL-2 fusion protein is increased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein has enhanced or increased half-life in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., greater than about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein, e.g., as determined by ELISA, flow cytometry, and/or mass spectrometry.

In an embodiment, the IL-2 fusion protein has altered (e.g., reduced or decreased) turnover in vitro and/or in vivo, relative to an IL-2 fusion protein comprising a wild-type IL-2 or a reference IL-2 fusion protein. In an embodiment, the IL-2 fusion protein has reduced or decreased turnover relative to an IL-2 fusion protein comprising a wild-type IL-2. In an embodiment, the IL-2 fusion protein has reduced or decreased turnover relative to a reference IL-2 fusion protein. In an embodiment, the turnover of the IL-2 fusion protein is decreased by about 1%, 5%, 10%, 20%, 30%, 40%, 50%, 60%, 70%, 80%, 90%, 95%, or about 100%, or more. In an embodiment, the turnover of the IL-2 fusion protein is decreased by about 0.5-fold, 1-fold, 2-fold, 3-fold, 4-fold, 5-fold, 6-fold, 7-fold, 8-fold, 9-fold, about 10-fold, or more. In an embodiment, the IL-2 fusion protein has a lower, reduced or decreased rate or level of turnover and/or clearance in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein, e.g., as determined by ELISA, flow cytometry, and/or mass spectrometry.

In an embodiment, the IL-2 fusion protein provided by the disclosure comprise the property of having altered (e.g., reduced or decreased) susceptibility to proteolysis in vitro and/or in vivo, relative to an IL-2 fusion protein comprising a wild-type IL-2 or a reference IL-2 fusion protein. In an embodiment, the IL-2 fusion protein has reduced or decreased susceptibility to proteolysis relative to IL-2 (e.g., wild type human IL-2). In an embodiment, the IL-2 fusion protein has reduced or decreased susceptibility to proteolysis relative to a reference IL-2 fusion protein. In an embodiment, the susceptibility to proteolysis of the IL-2 fusion protein is decreased by about 1%, 5%, 10%, 20%, 30%, 40%, 50%, 60%, 70%, 80%, 90%, 95%, or about 100%, or more. In an embodiment, the susceptibility to proteolysis of the IL-2 fusion protein is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., enhanced or increased) resistance to proteolysis in vitro and/or in vivo, relative to an IL-2 fusion protein comprising a wild-type IL-2 or a reference IL-2 fusion protein. In an embodiment, the IL-2 fusion protein has enhanced or increased resistance to proteolysis relative to an IL-2 fusion protein comprising a wild-type IL-2. In an embodiment, the IL-2 fusion protein has enhanced or increased resistance to proteolysis relative to a reference IL-2 fusion protein. In an embodiment, the resistance to proteolysis of the IL-2 fusion protein is increased by about 1%, 5%, 10%, 20%, 30%, 40%, 50%, 60%, 70%, 80%, 90%, 95%, or about 100%, or more. In an embodiment, the resistance to proteolysis of the IL-2 fusion protein is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., reduced or decreased) binding capacity and/or binding affinity for human CD25 in vitro and/or in vivo, relative to an IL-2 fusion protein comprising a wild-type IL-2 or a reference IL-2 fusion protein. In an embodiment, the IL-2 fusion protein has reduced or decreased binding capacity and/or binding affinity for human CD25 relative to a wild-type human IL-2). In an embodiment, the IL-2 fusion protein has reduced or decreased binding capacity and/or binding affinity for human CD25 relative to a reference IL-2 fusion protein. In an embodiment, the binding capacity and/or binding affinity of the IL-2 fusion protein for human CD25 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 fusion protein for human CD25 is decreased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein has reduced or decreased binding affinity for CD25 (e.g., human CD25), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined by yeast surface display, surface plasmon resonance (e.g. Biacore) and/or bio-layer interferometry (e.g. Octet binding).

In an embodiment, the IL-2 fusion protein binds to CD25 (e.g., human CD25) with low affinity, e.g., with a dissociation constant ($K_D$) of about 5-500 pM, e.g., about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, or e.g., about 10 to about 400 PM, about 20 to about 300 pM, about 50 to about 200 pM, about 100 to about 150 pM, about 5 to about 10 pM, about 10 to about 20 pM, about 20 to about 30 pM, or about 30 to about 40 pM, e.g., about 40 to about 50 pM, about 50 to about 60 pM, about 60 to about 70 pM, about 70 to about 80 pM, about 80 to about 90 pM, about 90 to about 100 pM, about 100 to about 110 pM, about 110 to about 120 pM, about 120 to about 130 pM, about 130 to about 140 pM about 140 to about 150 pM, about 150 to about 200 pM, about 200 to about 250 pM, about 250 to about 300 PM, about 300 to about 350 pM, about 350 to about 400 pM, about 400 to about 500 pM, or e.g., greater than about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, e.g. as determined by yeast surface display, surface plasmon resonance (e.g. Biacore) and/or biolayer interferometry (e.g. Octet binding).

In an embodiment, the IL-2 fusion protein binds to CD25 (e.g., human CD25) with low affinity, e.g., with a dissociation constant ($K_D$) of about 0.1-10 nM, e.g., about 0.1, about 0.2, about 0.3, about 0.4, about 0.5, about 0.6, about 0.7, about 0.8, about 0.9, about 1, about 1.5, about 2, about 2.5, about 3, about 3.5, about 4, about 4.5, about 5, about 6, about 7, about 8, about 9, or about 10 nM, or e.g., about 0.2 to about 5 nM, about 0.5 to about 2 nM, about 1 to 1.5 nM, about 0.1 to about 0.2 nM, about 0.2 to about 0.3 nM, about 0.3 to about 0.4 nM, or about 0.4 to about 0.5 nM, e.g., about 0.5 to about 0.6 nM, about 0.6 to about 0.7 nM, about 0.7 to about 0.8 nM, about 0.8 to about 0.9 nM, about 0.9 to about 1 nM, about 1 to about 1.5 nM, about 1.5 to about 2 nM, about 2.5 to about 3 nM, about 3.5 to about 4 nM, about 4 to about 4.5 nM, about 4.5 to about 5 nM, about 5 to about 6 nM, about 6 to about 7 nM, about 7 to about 8 nM, about 8 to about 9 nM, or about 9 to about 10 nM, or e.g., greater than about 0.1, about 0.2, about 0.3, about 0.4, about 0.5, about 0.6, about 0.7, about 0.8, about 0.9, about 1, about 2, about 3, about 4, about 5, about 6, about 7, about 8, about 9, or about 10 nM, e.g., as determined by surface plasmon resonance (e.g. Biacore) and/or bio-layer interferometry (e.g., Octet binding).

In an embodiment, the IL-2 fusion protein has altered (e.g., reduced or decreased) binding capacity and/or binding affinity for human CD132 in vitro and/or in vivo, relative to an IL-2 fusion protein comprising a wild-type IL-2 or a reference IL-2 fusion protein. In an embodiment, the IL-2 fusion protein has reduced or decreased binding capacity and/or binding affinity for human CD132 relative to an IL-2 fusion protein comprising a wild-type IL-2. In an embodiment, the IL-2 fusion protein has reduced or decreased binding capacity and/or binding affinity for human CD132 relative to a reference IL-2 fusion protein. In an embodiment, the binding capacity and/or binding affinity of the IL-2 fusion protein for human CD132 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 fusion protein for human CD132 is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., reduced or decreased) binding capacity and/or binding affinity for the human dimeric IL-2 receptor comprising human CD122 and human CD132 in vitro and/or in vivo, relative to an IL-2 fusion protein comprising a wild-type IL-2 or a reference IL-2 fusion protein. In an embodiment, the IL-2 fusion protein has reduced or decreased binding capacity and/or binding affinity for the human dimeric IL-2 receptor comprising human CD122 and human CD132 relative to an IL-2 fusion protein comprising a wild-type IL-2. In an embodiment, the IL-2 fusion protein has reduced or decreased binding capacity and/or binding affinity for the human dimeric IL-2 receptor comprising human CD122 and human CD132 relative to a reference IL-2 fusion protein. In an embodiment, the binding capacity and/or binding affinity of the IL-2 fusion protein for the human dimeric IL-2 receptor comprising human CD122 and human CD132 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 fusion protein for the human dimeric IL-2 receptor comprising human CD122 and human CD132 is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., enhanced, increased, and/or selective) binding to Tregs in vitro and/or in vivo, relative to an IL-2 fusion protein comprising a wild-type IL-2 or a reference IL-2 fusion protein. In an embodiment, the IL-2 fusion protein has enhanced or increased binding to Tregs relative to an IL-2 fusion protein comprising a wild-type IL-2. In an embodiment, the IL-2 fusion protein has selective binding to Tregs relative to IL-2 (e.g., wild type human IL-2). In an embodiment, the IL-2 fusion protein has enhanced or increased binding to Tregs relative to a reference IL-2 fusion protein. In an embodiment, the IL-2 fusion protein has selective binding to Tregs relative to a reference IL-2 fusion protein. In an embodiment, the binding to Tregs is increased by about 1%, 5%, 10%, 20%, 30%, 40%, 50%, 60%, 70%, 80%, 90%, 95%, or about 100%, or more. In an embodiment, the binding to Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has reduced or decreased binding affinity for CD122/CD132 heterodimer (e.g., human CD122/CD132 heterodimer), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined by yeast surface display, surface plasmon resonance (e.g. Biacore) and/or bio-layer interferometry (e.g. Octet binding).

In an embodiment, the IL-2 fusion protein binds to CD122/CD132 heterodimer (e.g., human CD122/CD132 heterodimer) with low affinity, e.g., with a dissociation constant ($K_D$) of about 0.2-20 nM, e.g., about 0.2, about 0.3, about 0.4, about 0.5, about 0.6, about 0.7, about 0.8, about 0.9, about 1, about 1.1, about 1.2, about 1.3, about 1.4, about 1.5, about 2, about 3, about 4, about 5, about 6, about 7, about 8, about 9, about 10, about 11, about 12, about 13, about 14, about 15, about 16, about 17, about 18, or about 20 nM, or e.g., about 0.5 to about 15 nM, about 1 to about 10 nM, about 2 to about 5 nM, about 0.2 to about 0.3 nM, about 0.3 to about 0.4 nM, about 0.4 to about 0.5 nM, about 0.5 to about 0.6 nM, about 0.6 to about 0.7 nM, about 0.7 to about 0.8 nM, about 0.8 to about 0.9 nM, about 0.9 to about 1 nM, about 1 to about 1.1 nM, about 1.1 to about 1.2 nM, about 1.2 to about 1.3 nM, about 1.3 to about 1.4 nM, about 1.4 to about 1.5 nM, about 1.5 to about 2 nM, about 2 to about 3 nM, about 3 to about 4 nM, about 4 to about 5 nM, about 5 to about 6 nM, about 6 to about 7 nM, about 7 to about 8 nM, about 8 to about 9 nM, about 9 to about 10 nM, about 10 to about 11 nM, about 11 to about 12 nM, about 12 to about 13 nM, about 13 to about 14 nM, about 14 to about 15 nM, about 15 to about 16 nM, about 16 to about 17 nM, about 17 to about 18 nM, about 18 to about 19 nM, or about 19 to about 20 nM, or e.g., greater than about 0.2, about 0.3, about 0.4, about 0.5, about 0.6, about 0.7, about 0.8, about 0.9, about 1, about 1.1, about 1.2, about 1.3, about 1.4, about 1.5, about 2, about 3, about 4, about 5, about 6, about 7, about 8, about 9, about 10, about 11, about 12, about 13, about 14, about 15, about 16, about 17, about 18, or about 20 nM, e.g., as determined by yeast surface display.

In an embodiment, the IL-2 fusion protein binds to CD122/CD132 heterodimer (e.g., human CD122/CD132 heterodimer) with low affinity, e.g., with a dissociation constant ($K_D$) of about 0.2-300 nM, e.g., about 0.2 nM, about 0.5 nM, about 1 nM, about 2 nM, about 5 nM, about 10 nM, about 15 nM, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or about 300 nM, or e.g., about 0.5 to about 15 nM, about 1 to about 10 nM, about 2 to about 5 nM, about 0.2 nM to about 0.5 nM, about 0.5 nM to about 1 nM, about 1 to about 2 nM, about 2 nM to about 5 nM, about 5 nM to about 10 nM, about 10 nM to about 15 nM, about 15 nM to about 20 nM, about 20 nM to about 25 nM, about 25 to about 30 nM, about 30 nM to about 40 nM, about 40 nM to about 50 nM, about 50 to about 60 nM, about 60 to about 70 nM, about 70 nM to about 80 nM, about 80 nM to about 90 nM, about 90 nM to about 100 nM, about 100 nM to about 110 nM, about 110 nM to about 120 nM, about 120 nM to about 130 nM, about 130 nM to about 140 nM, about 140 nM to about 150 nM, about 150 nM to about 160 nM, about 160 nM to about 170 nM, about 170 nM to about 180 nM, about 180 nM to about 190 nM, about 190 nM to about 200 nM, about 200 nM to about 210 nM, about 210 nM to about 220 nM, about 220 nM to about 230 nM, about 230 nM to about 240 nM, about 240 nM to about 250 nM, about 250 nM to about 260 nM, about 260 nM to about 270 nM, about 270 nM to about 280 nM, about 280 nM to about 290 nM, or about 290 nM to about 300 nM, or e.g., greater than about 0.2, about 0.5, about 1, about 2, about 5, about 10, about 15, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about about 260 nM, about 270 nM, about 280 nM, about 290 nM, or greater than about 300 nM, e.g., as determined by surface plasmon resonance (e.g. Biacore) and/or biolayer interferometry (e.g. Octet binding).

In an embodiment, the IL-2 fusion protein has altered (e.g., enhanced, increased, and/or selective) binding to Tregs in vitro and/or in vivo, relative to an IL-2 fusion protein comprising wild-type IL-2 or a reference IL-2 fusion protein. In an embodiment, the IL-2 fusion protein has enhanced or increased binding to Tregs relative to an IL-2 fusion protein comprising wild-type IL-2. In an embodiment, the IL-2 fusion protein has selective binding to Tregs relative to IL-2 (e.g., wild type human IL-2). In an embodiment, the IL-2 fusion protein has enhanced or increased binding to Tregs relative to a reference IL-2 fusion protein. In an embodiment, the IL-2 fusion protein has selective binding to Tregs relative to a reference IL-2 fusion protein.

In an embodiment, the binding to Tregs is increased by about 1%, 5%, 10%, 20%, 30%, 40%, 50%, 60%, 70%, 80%, 90%, 95%, or about 100%, or more. In an embodiment, the binding to Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., enhanced, increased, and/or selective) activation of the IL-2 signaling pathway in Tregs in vitro and/or in vivo, relative to an IL-2 fusion protein comprising a wild-type IL-2 or a reference IL-2 fusion protein. In an embodiment, the IL-2 fusion protein has enhanced or increased activation of the IL-2 signaling pathway in Tregs relative to an IL-2 fusion protein comprising a wild-type IL-2. In an embodiment, the IL-2 fusion protein has selective activation of the IL-2 signaling pathway in Tregs relative to an IL-2 fusion protein comprising a wild-type IL-2. In an embodiment, the IL-2 fusion protein has enhanced or increased activation of the IL-2 signaling pathway in Tregs relative to a reference IL-2 fusion protein. In an embodiment, the IL-2 fusion protein has selective activation of the IL-2 signaling pathway in Tregs relative to a reference IL-2 fusion protein. In an embodiment, the activation of the IL-2 signaling pathway in Tregs is increased by about 1%, 5%, 10%, 20%, 30%, 40%, 50%, 60%, 70%, 80%, 90%, 95%, or about 100%, or more. In an embodiment, the activation of the IL-2 signaling pathway in Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein selectively activates IL-2 signaling in T regulatory cells in vitro and/or in vivo, e.g., having an T helper EC50/Treg EC50 ratio greater than about 1, about 2, about 3, about 4, about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 150, 200, 250, 300, 350, 400, 450, 500, 600, 700, 800, 900, 1000, 1500, 2000, 2500, or about 3000 or more relative to an IL-2 fusion protein comprising a wild-type IL-2 or a reference IL-2 fusion protein e.g., as determined flow cytometry.

In an embodiment, the IL-2 fusion protein selectively activates IL-2 signaling in T regulatory cells in vitro and/or in vivo, e.g., having an NK cell EC50/Treg EC50 ratio greater than e.g., about 1, about 2, about 3, about 4, about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 150, 200, 250, 300, 350, 400, 450, 500, 600, 700, 800, 900, 1000, 1500, 2000, 2500, or about 3000 or more, or e.g., greater than 1 and about 1 to 2, about 2 to 3, about 3 to 4, about 4 to 5, greater than 1 and about 1 to 10, greater than 1 and about 1 to 20, greater than 1 and about 1 to 30, greater than 1 and about 1 to 40, greater than 1 and about 1 to 50, about 2 to 10, about 2 to 20, about 2 to 30, about 2 to 40, 2 to 50, about 5 to 10, about 5 to 20, about 5 to 30, about 5 to 40, about 5 to 50, about 10 to 20, about 10 to 30, about 10 to 40 about 10 to 50, about 20 to 40, about 20 to 50, about 50 to 100, about 100 to 200, about 200 to 500, about 500 to 1000, about 1000 to 2000, or about 1000 to 3000, relative to an IL-2 fusion protein comprising a wild-type IL-2 or a reference IL-2 fusion protein e.g., as determined flow cytometry.

In an embodiment, the IL-2 fusion protein has altered (e.g., enhanced, increased, and/or selective) ability to induce or promote Treg expansion, activity, survival, and/or proliferation in vitro and/or in vivo, relative to an IL-2 fusion protein comprising a wild-type IL-2 or a reference IL-2 fusion protein. In an embodiment, the IL-2 fusion protein has enhanced or increased ability to induce or promote Treg expansion, activity, survival, and/or proliferation relative to an IL-2 fusion protein comprising a wild-type IL-2. In an embodiment, the IL-2 fusion protein has selective ability to induce or promote Treg expansion, activity, survival, and/or proliferation relative to an IL-2 fusion protein comprising a wild-type IL-2. In an embodiment, the IL-2 fusion protein has enhanced or increased ability to induce or promote Treg expansion, activity, survival, and/or proliferation relative to a reference IL-2 fusion protein. In an embodiment, the IL-2 fusion protein has selective ability to induce or promote Treg expansion, activity, survival, and/or proliferation relative to a reference IL-2 fusion protein. In an embodiment, the ability to induce or promote Treg expansion, activity, survival, and/or proliferation is increased by about 1%, 5%, 10%, 20%, 30%, 40%, 50%, 60%, 70%, 80%, 90%, 95%, or about 100%, or more. In an embodiment, the ability to induce or promote Treg expansion, activity, survival, and/or proliferation is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has enhanced or increased potency and/or ability to induce or promote T regulatory cell activity, e.g., having an EC50 for Tregs that is lower by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined flow cytometry.

In an embodiment, the IL-2 fusion protein has reduced or decreased potency and/or ability to induce or promote T regulatory cell activity, e.g., having an EC50 for Tregs that is higher by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, about 50-fold, about 100-fold, about 200-fold, about 500-fold, about 1000-fold, about 2000-fold, about 5000-fold, about 10,000, about 15,000-fold, or about 20,000-fold or more e.g., relative to an IL-2 fusion protein comprising a wild-type IL-2 or a reference IL-2 fusion protein e.g., as determined flow cytometry.

In an embodiment, the T helper cell described herein is a CD45+CD3+CD4+Foxp3− cell, e.g., determined by flow cytometry. In an embodiment, the Treg described herein is CD45+CD3+CD4+Foxp3+ cell, e.g., determined by flow cytometry. In an embodiment, the NK cell described herein is a CD45+CD3− cell that is CD56+ and/or CD16+, e.g., determined by flow cytometry. In an embodiment, the NK cell described herein is a CD45+CD3−CD56+ cell, e.g., determined by flow cytometry.

In an embodiment, the IL-2 fusion protein has one or more of the same, or substantially the same, structural and/or functional properties, as an IL-2 fusion protein comprising a wild-type IL-2 or a reference IL-2 fusion protein.

In an embodiment, the reference IL-2 fusion protein comprises an amino acid sequence that has about 75%, 80%, 85%, 90%, 91%, 92%, 93%, 94%, 95%, 96%, 97%, 98%, 99%, or more sequence identity to an IL-2 fusion protein described herein. In an embodiment, the reference IL-2 fusion protein comprises an IL-2 variant comprising the amino acid sequence of SEQ ID NO: 57. In an embodiment, the IL-2 fusion protein comprises an amino acid sequence that is at least 80%, 85%, 90%, 95%, or 98% identical to the amino acid sequence of SEQ ID NO: 57 and comprises one or more (2, 3, 4, 5, 6, 7, 8, 9, 10, or more) amino acid alterations (e.g., substitutions) described herein.

In an embodiment, the IL-2 fusion protein comprises an IL-2 polypeptide (e.g., a human IL-2 polypeptide) described herein. In an embodiment, the IL-2 fusion protein is encoded by a nucleic acid comprising a nucleotide sequence described herein.

In an embodiment, the IL-2 fusion protein comprises an amino acid alteration (e.g., substitution) at one or more (e.g., 2, 3, 4, 5, 6, 7, 8, 9, 10, 11, 12, 13, 14, or all) of positions in IL-2, as described herein. In an embodiment, the IL-2 fusion protein comprises an amino acid alteration (e.g., substitution) at one or more (e.g., 2, 3, 4, 5, 6, 7, 8, 9, 10, 11, 12, 13, 14, or all) of positions chosen from T3, H16, I28, K35, R38, F42, E68, V69, Q74, D84, S87, N88, I92, C125, or Q126 in IL-2.

In an embodiment, the IL-2 fusion protein comprises an amino acid alteration (e.g., substitution) at position T3 in IL-2. In an embodiment, the IL-2 fusion protein comprises an amino acid alteration (e.g., substitution) at position H16 in IL-2. In an embodiment, the IL-2 fusion protein comprises an amino acid alteration (e.g., substitution) at position I28 in IL-2. In an embodiment, the IL-2 fusion protein comprises an amino acid alteration (e.g., substitution) at position K35 in IL-2. In an embodiment, the IL-2 fusion protein comprises an amino acid alteration (e.g., substitution) at position R38 in IL-2. In an embodiment, the IL-2 fusion protein comprises an amino acid alteration (e.g., substitution) at position F42 in IL-2. In an embodiment, the IL-2 fusion protein comprises an amino acid alteration (e.g., substitution) at position E68 in IL-2. In an embodiment, the IL-2 fusion protein comprises an amino acid alteration (e.g., substitution) at position V69 in IL-2. In an embodiment, the IL-2 fusion protein comprises an amino acid alteration (e.g., substitution) at position Q74 in IL-2. In an embodiment, the IL-2 fusion protein comprises an amino acid alteration (e.g., substitution) at position D84 in IL-2. In an embodiment, the IL-2 fusion protein comprises an amino acid alteration (e.g., substitution) at position S87 in IL-2. In an embodiment, the IL-2 fusion protein comprises an amino acid alteration (e.g., substitution) at position N88 in IL-2. In an embodiment, the IL-2 fusion protein comprises an amino acid alteration (e.g., substitution) at position I92 in IL-2. In an embodiment, the IL-2 fusion protein comprises an amino acid alteration (e.g., substitution) at position C125 in IL-2. In an embodiment, the IL-2 fusion protein comprises an amino acid alteration (e.g., substitution) at position Q126 in IL-2.

In an embodiment, the IL-2 fusion protein comprises an amino acid alteration (e.g., substitution) at position V69, Q74, or both, in IL-2. In an embodiment, the IL-2 fusion protein comprises an amino acid alteration (e.g., substitution) at positions V69 and Q74 in IL-2. In an embodiment, the IL-2 fusion protein comprises the amino acid substitution V69A in IL-2. In an embodiment, the IL-2 fusion protein comprises the amino acid substitution Q74P in IL-2.

In an embodiment, the IL-2 fusion protein comprises an amino acid alteration (e.g., substitution) at position H16, I92, D84, or a combination thereof, in IL-2. In an embodiment, the IL-2 fusion protein comprises an amino acid alteration (e.g., substitution) at position H16, optionally wherein the amino acid substitution is H16N, H16L, or H16D, in IL-2. In an embodiment, the IL-2 fusion protein comprises the amino acid substitution H16N in IL-2. In an embodiment, the IL-2 fusion protein comprises the amino acid substitution H16L in IL-2. In an embodiment, the IL-2 fusion protein comprises the amino acid substitution H16D in IL-2.

In an embodiment, the IL-2 fusion protein comprises an amino acid alteration (e.g., substitution) at position at I92, optionally wherein the amino acid substitution is I92S, in IL-2. In an embodiment, the IL-2 fusion protein comprises the amino acid substitution I92S in IL-2.

In an embodiment, the IL-2 fusion protein comprises an amino acid alteration (e.g., substitution) at position D84, optionally wherein the amino acid substitution is D84V, in IL-2. In an embodiment, the IL-2 fusion protein comprises the amino acid substitution is D84V in IL-2.

In an embodiment, the IL-2 fusion protein comprises an amino acid alteration (e.g., substitution) at position K35, R38, F42, E68, or a combination thereof, in IL-2. In an embodiment, the IL-2 fusion protein comprises an amino acid alteration (e.g., substitution) at position K35, optionally wherein the amino acid substitution is K35E, in IL-2. In an embodiment, IL-2 fusion protein comprises the amino acid substitution K35E in IL-2.

In an embodiment, the IL-2 fusion protein comprises an amino acid alteration (e.g., substitution) at position R38, optionally wherein the amino acid substitution is R38E, R38N or R38Q, in IL-2. In an embodiment, the IL-2 fusion protein comprises the amino acid substitution R38N in IL-2. In an embodiment, the IL-2 fusion protein comprises the amino acid substitution R38Q in IL-2.

In an embodiment, the IL-2 fusion protein comprises an amino acid alteration (e.g., substitution) at position F42, optionally wherein the amino acid substitution is F42K or F42Q, in IL-2. In an embodiment, the IL-2 fusion protein comprises the amino acid substitution F42K in IL-2. In an embodiment, the IL-2 fusion protein comprises the amino acid substitution F42Q in IL-2.

In an embodiment, the IL-2 fusion protein comprises an amino acid alteration (e.g., substitution): (i) at (a) positions V69 and Q74, (b) position K35, or (c) positions V69, Q74, and K35; and (ii) at one, two, or all of positions H16, I92, or D84, in IL-2. In an embodiment, the IL-2 fusion protein further comprises an amino acid alteration (e.g., substitution) at one, two, or all of positions R38, F42, or E68, in IL-2.

In an embodiment, the IL-2 fusion protein comprises an amino acid alteration (e.g., substitution): (i) at (a) positions V69 and Q74, (b) position K35, or (c) positions V69, Q74, and K35; and (ii) at (a) one, two, or all of positions H16, I92, or D84; or (b) one, two, or all of positions R38, F42, or E68, in IL-2.

In an embodiment, the IL-2 fusion protein comprises an amino acid alteration (e.g., substitution): (i) at (a) positions V69 and Q74, (b) position K35, or (c) positions V69, Q74, and K35; and (ii) at (a) one, two, or all of positions H16, I92, or D84; and (b) one, two, or all of positions R38, F42, or E68, in IL-2.

In an embodiment, the IL-2 fusion protein comprises an amino acid alteration (e.g., substitution) at position V69, Q74, and H16, optionally wherein the amino acid substitution is V69A, Q74P, and H16N or H16L, respectively, in IL-2. In an embodiment, the IL-2 fusion protein comprises the amino acid substitutions V69A, Q74P, and H16N or H16L, in IL-2. In an embodiment, the IL-2 fusion protein comprises the amino acid substitutions V69A, Q74P, and H16N, in IL-2. In an embodiment, the IL-2 fusion protein comprises the amino acid substitutions V69A, Q74P, and H16L, in IL-2.

In an embodiment, the IL-2 fusion protein comprises an amino acid alteration (e.g., substitution) at position V69, Q74, and I92, optionally wherein the amino acid substitution is V69A, Q74P, and I92S, respectively, in IL-2. In an embodiment, the IL-2 fusion protein comprises the amino acid substitutions V69A, Q74P, and I92S, in IL-2.

In an embodiment, the IL-2 fusion protein comprises an amino acid alteration (e.g., substitution) at position V69, Q74, and D84, optionally wherein the amino acid substitution is V69A, Q74P, and D84V, respectively, in IL-2. In an embodiment, the IL-2 fusion protein comprises the amino acid substitutions V69A, Q74P, and D84V, in IL-2.

In an embodiment, the IL-2 fusion protein comprises an amino acid alteration (e.g., substitution) at position V69, Q74, and R38, optionally wherein the amino acid substitution is V69A, Q74P, and R38Q, respectively, in IL-2. In an embodiment, the IL-2 fusion protein comprises the amino acid substitutions V69A, Q74P, and R38Q, in IL-2.

In an embodiment, the IL-2 fusion protein comprises an amino acid alteration (e.g., substitution) at position V69, Q74, and F42, optionally wherein the amino acid substitution is V69A, Q74P, and F42Q, respectively, in IL-2. In an embodiment, the IL-2 fusion protein comprises the amino acid substitutions V69A, Q74P, and F42Q, in IL-2.

In an embodiment, the IL-2 fusion protein comprises an amino acid alteration (e.g., substitution) at position V69, Q74, and R38, optionally wherein the amino acid substitution is V69A, Q74P, and R38N, respectively, in IL-2. In an embodiment, the IL-2 fusion protein comprises the amino acid substitutions V69A, Q74P, and R38N, in IL-2.

In an embodiment, the IL-2 fusion protein comprises an amino acid alteration (e.g., substitution) at position V69, Q74, and R38, optionally wherein the amino acid substitution is V69A, Q74P, and R38E, respectively, in IL-2. In an embodiment, the IL-2 fusion protein comprises the amino acid substitution V69A, Q74P, and R38E, in IL-2.

In an embodiment, the IL-2 fusion protein comprises an amino acid alteration (e.g., substitution) at position V69, Q74, K35, and H16, optionally wherein the amino acid substitution is V69A, Q74P, K35E, and H16N, respectively, in IL-2. In an embodiment, the IL-2 fusion protein comprises the amino acid substitutions V69A, Q74P, K35E, and H16N, in IL-2.

In an embodiment, the IL-2 fusion protein comprises an amino acid alteration (e.g., substitution) at position V69, Q74, K35, H16, and R38, optionally wherein the amino acid substitution is V69A, Q74P, K35E, H16N, and R38N, respectively, in IL-2. In an embodiment, the IL-2 fusion protein comprises the amino acid substitutions V69A, Q74P, K35E, H16N, and R38N, in IL-2.

In an embodiment, the IL-2 fusion protein comprises an amino acid alteration (e.g., substitution) at position V69, Q74, H16, and R38, optionally wherein the amino acid substitution is V69A, Q74P, H16N, and R38N or R38Q, respectively, in IL-2. In an embodiment, the IL-2 fusion protein comprises the amino acid substitutions V69A, Q74P, H16N, and R38N or R38Q, in IL-2. In an embodiment, the IL-2 fusion protein comprises the amino acid substitutions V69A, Q74P, H16N, and R38N, in IL-2. In an embodiment, the IL-2 fusion protein comprises the amino acid substitutions V69A, Q74P, H16N, and R38Q, in IL-2.

In an embodiment, the IL-2 fusion protein comprises an amino acid alteration (e.g., substitution) at position I28, E68, S87, N88, Q126, or a combination thereof, in IL-2.

In an embodiment, the IL-2 fusion protein comprises an amino acid alteration (e.g., substitution) at position I28, optionally wherein the amino acid substitution is I28T or I28F, in IL-2. In an embodiment, the IL-2 fusion protein comprises the amino acid substitution I28T in IL-2. In an embodiment, the IL-2 fusion protein comprises the amino acid substitution I28F in IL-2.

In an embodiment, the IL-2 fusion protein comprises an amino acid alteration (e.g., substitution) at position E68, optionally wherein the amino acid substitution is E68Q or E68N, in IL-2. In an embodiment, the IL-2 fusion protein comprises the amino acid substitution E68Q in IL-2. In an embodiment, the IL-2 fusion protein comprises the amino acid substitution E68N in IL-2.

In an embodiment, the IL-2 fusion protein comprises an amino acid alteration (e.g., substitution) at position S87, optionally wherein the amino acid substitution is S87R, in IL-2. In an embodiment, the IL-2 fusion protein comprises the amino acid substitution S87R in IL-2.

In an embodiment, the IL-2 fusion protein comprises an amino acid alteration (e.g., substitution) at position N88, optionally wherein the amino acid substitution is N88S, N88L, or N88D, in IL-2. In an embodiment, the IL-2 fusion protein comprises the amino acid substitution N88S, N88L, or N88D, in IL-2. In an embodiment, the IL-2 fusion protein comprises the amino acid substitution N88S in IL-2. In an embodiment, the IL-2 fusion protein comprises the amino acid substitution N88L in IL-2. In an embodiment, the IL-2 fusion protein comprises the amino acid substitution N88D in IL-2.

In an embodiment, the IL-2 fusion protein comprises an amino acid alteration (e.g., substitution) at position Q126, optionally wherein the amino acid substitution is Q126T, Q126K, or Q126R, in IL-2. In an embodiment, the IL-2 fusion protein comprises the amino acid substitution Q126T, Q126K, or Q126R, in IL-2. In an embodiment, the IL-2 fusion protein comprises the amino acid substitution Q126T, Q126K, or Q126R, in IL-2. In an embodiment, the IL-2 fusion protein comprises the amino acid substitution Q126T in IL-2. In an embodiment, the IL-2 fusion protein comprises the amino acid substitution Q126K in IL-2. In an embodiment, the IL-2 fusion protein comprises the amino acid substitution Q126R in IL-2.

In an embodiment, the IL-2 fusion protein comprises an amino acid alteration (e.g., substitution) at position C125 in IL-2, optionally wherein the amino acid substitution is C125S. In an embodiment, the IL-2 fusion protein comprises the amino acid substitution C125S in IL-2.

In an embodiment, the IL-2 fusion protein comprises an amino acid alteration (e.g., substitution) at position T3 in IL-2, optionally wherein the amino acid substitution is T3A. In an embodiment, the IL-2 fusion protein comprises the amino acid substitution T3A in IL-2.

In an embodiment, the IL-2 fusion protein comprises an amino acid alteration (e.g., substitution) at position V69, Q74, and C125, in IL-2, optionally wherein the amino acid substitution is V69A, Q74P, and C125S, respectively. In an embodiment, the IL-2 fusion protein comprises the amino acid substitutions V69A, Q74P, and C125S, in IL-2.

In an embodiment, the IL-2 fusion protein comprises an amino acid alteration (e.g., substitution) at position T3, H16, I92, in IL-2, or a combination thereof, optionally wherein the amino acid substitution is T3A, H16N, and I92S, in IL-2, respectively.

In an embodiment, the IL-2 fusion protein comprises an amino acid alteration (e.g., substitution) at position H16, V69, Q74, and C125, in IL-2, optionally wherein the amino acid substitution is H16N, V69A, Q74P, and C125S, in IL-2, respectively. In an embodiment, the IL-2 fusion protein comprises the amino acid substitutions H16N, V69A, Q74P, and C125S in IL-2.

In an embodiment, the IL-2 fusion protein comprises an amino acid alteration (e.g., substitution) at position H16, V69, Q74, and C125, in IL-2, optionally wherein the amino acid substitution is H16L, V69A, Q74P, and C125S, in IL-2, respectively. In an embodiment, the IL-2 fusion protein comprises the amino acid substitutions H16L, V69A, Q74P, and C125S, in IL-2.

In an embodiment, the IL-2 fusion protein comprises an amino acid alteration (e.g., substitution) at position H16, V69, Q74, I92, and C125, in IL-2, optionally wherein the amino acid substitution is H16L, V69A, Q74P, I92S, and C125S, in IL-2, respectively. In an embodiment, the IL-2 fusion protein comprises the amino acid substitutions H16L, V69A, Q74P, I92S, and C125S, in IL-2.

In an embodiment, the IL-2 fusion protein comprises an amino acid alteration (e.g., substitution) at position T3, V69, Q74, and C125, in IL-2, optionally wherein the amino acid substitution is T3A, V69A, Q74P, and C125S, in IL-2, respectively. In an embodiment, the IL-2 fusion protein comprises the amino acid substitutions T3A, V69A, Q74P, and C125S, in IL-2.

In an embodiment, the IL-2 fusion protein comprises an amino acid alteration (e.g., substitution) at position T3, H16, V69, Q74, and C125, in IL-2, optionally wherein the amino acid substitution is T3A, H16N or H16L, V69A, Q74P, and C125S, in IL-2, respectively. In an embodiment, the IL-2 fusion protein comprises the amino acid substitutions T3A, H16N, V69A, Q74P, and C125S. In an embodiment, the IL-2 fusion protein comprises the amino acid substitutions T3A, H16L, V69A, Q74P, and C125S, in IL-2.

In an embodiment, the IL-2 fusion protein comprises an amino acid alteration (e.g., substitution) at position T3, V69, Q74, I92, and C125, in IL-2, optionally wherein the amino acid substitution is T3A, V69A, Q74P, I92S, and C125S, in IL-2, respectively. In an embodiment, the IL-2 fusion protein comprises the amino acid substitutions T3A, V69A, Q74P, I92S, and C125S, in IL-2. In an embodiment, the IL-2 fusion protein comprises the amino acid substitutions T3A, V69A, Q74P, I92S, and C125S, in IL-2.

In an embodiment, the IL-2 fusion protein comprises an amino acid alteration (e.g., substitution) at position H16, K35, V69 and Q74, optionally wherein the amino acid substitution is H16L, K35E, V69A, and Q74P, respectively, in IL-2. In an embodiment, the IL-2 fusion protein comprises the amino acid substitutions H16L, K35E, V69A, and Q74P, in IL-2.

In an embodiment, the IL-2 fusion protein comprises an amino acid alteration (e.g., substitution) at position H16, R38, V69A, and Q74P, optionally wherein the amino acid substitution is H16L, R38Q, V69A, and Q74P, respectively, in IL-2. In an embodiment, the IL-2 fusion protein comprises the amino acid substitutions H16L, R38Q, V69A, and Q74P, in IL-2.

In an embodiment, the IL-2 fusion protein comprises the amino acid substitutions H16L, V69A, Q74P, and C125S, in IL-2.

Without wishing to be bound by theory, it is believed that in an embodiment, an IL-2 fusion protein comprising the amino acid substitutions H16L, V69A, Q74P, and C125S, can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 variant comprising the amino acid substitutions H16L, V69A, Q74P, and C125S particularly suitable for treating disorders and conditions arising from abnormal immune responses.

Thus, in an embodiment, an IL-2 fusion protein comprising amino acid substitutions H16L, V69A, Q74P, and C125S, has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased or substantially unchanged binding capacity and/or binding affinity for human CD25 in vitro and/or in vivo; (vi) selective binding to regulatory T cells (e.g. Foxp3$^+$ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the IL-2 fusion protein comprises an IL-2 variant comprising an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an IL-2 variant comprising the amino acid sequence of SEQ ID NO: 4, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises an IL-2 variant comprising the amino acid sequence of SEQ ID NO: 5, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 11, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1000, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1001, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises the amino acid sequence of any of SEQ ID NOs: 4, 5, 11, 1000, 1001, or 1002, or a functional fragment thereof. In an embodiment, the IL-2 fusion protein comprises the amino acid sequence of SEQ ID NO: 4 or 5, or a functional fragment thereof. In an embodiment, the IL-2 fusion protein comprises the amino acid sequence of SEQ ID NO: 4, or a functional fragment thereof. In an embodiment, the IL-2 fusion protein comprises the amino acid sequence of SEQ ID NO: 5, or a functional fragment thereof. In an embodiment, the IL-2 fusion protein comprises the amino acid sequence of SEQ ID NO: 11, or a functional fragment thereof. In an embodiment, the IL-2 fusion protein comprises the amino acid sequence of SEQ ID NO: 1000, or a functional fragment thereof. In an embodiment, the IL-2 fusion protein comprises the amino acid sequence of SEQ ID NO: 1001, or a functional fragment thereof. In an embodiment, the IL-2 fusion protein comprises the amino acid sequence of SEQ ID NO: 1002, or a functional fragment thereof.

Without wishing to be bound by theory, it is believed that in an embodiment, an IL-2 fusion protein comprising the amino acid sequence of SEQ ID NO: 5, or a functional fragment thereof, can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 fusion protein comprising the amino acid sequence of SEQ ID NO: 5 particularly suitable for treating disorders and conditions arising from abnormal immune responses.

Thus, in an embodiment, an IL-2 fusion protein comprising the amino acid sequence SEQ ID NO: 5, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto, has inter alia one or more (e.g., 2, 3, 4, 5, 6, 7, or all) of the following properties relative to a wild-type IL-2 or a reference IL-2 fusion protein that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 fusion protein for the heterodimeric IL-2 receptor composed of human CD122 and human CD132 (i.e. human CD122/CD132 heterodimer) in vitro and/or in vivo; (v) reduced or decreased or substantially unchanged binding capacity and/or binding affinity for human CD25 in vitro and/or in vivo; (vi) selective binding to regulatory T cells (e.g. Foxp3$^+$ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the IL-2 fusion proteins described herein comprise an Fc region, e.g. an Fc region having one or more mutations described herein, and/or having one or more structural or functional properties described herein. Without wishing to be bound by theory, it is believed that in an embodiment, the Fc regions described herein can reduce (e.g., prevent) renal clearance and/or extend half-life of the IL-2 agents (e.g., via FcRn).

As used herein, the term "fusion protein" refers to a protein, comprising two or more protein or peptide components. The two or more protein or peptide components can be obtained from different sources or encoded by different genes. A fusion protein is sometimes also referred to as a chimeric protein. An Fc fusion protein (also known as Fc chimeric fusion protein, Fc-Ig, Ig-based chimeric fusion protein, or Fc-tag protein) can include an Fc region of an immunoglobulin (e.g., an Fc region described herein) linked (e.g., fused) to a protein or peptide. The Fc region can be linked (e.g., fused genetically) to the protein or peptide directly, or indirectly, e.g., through a linker. In an embodiment, the Fc region is derived from the Fc region of IgG, e.g., human IgG, e.g., IgG1, IgG2, IgG3, or IgG4. In an embodiment, the Fc region is derived from the Fc region of IgG1, e.g., human IgG1.

An IL-2 fusion protein can include an IL-2 variant (e.g., an IL-2 variant described herein), or a functional fragment thereof, linked (e.g., fused) to a protein or peptide. In an embodiment, the IL-2 fusion protein is an IL-2-Fc fusion protein, e.g., further comprising an Fc region of an immunoglobulin (e.g., an Fc region described herein) linked (e.g., fused) to the IL-2 polypeptide (e.g., an IL-2 variant described herein) or a functional fragment thereof. In an embodiment, the IL-2 fusion protein is not an IL-2-Fc fusion protein, e.g., an IL-2 fusion variant described herein, or a functional fragment thereof, is linked (e.g., fused) to a protein or peptide other than an Fc region of IgG, e.g., human IgG, e.g., IgG1, IgG2, IgG3, or IgG4.

In an embodiment, the IL-2 fusion protein comprises an amino acid sequence chosen from: SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, or SEQ ID NO: 131, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, or SEQ ID NO: 169, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: I92, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, or SEQ ID NO: 207, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, or SEQ ID NO: 245, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, or SEQ ID NO: 283, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, or SEQ ID NO: 321, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, or SEQ ID NO: 359, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: 1004, SEQ ID NO: 1005, SEQ ID NO: 1006, SEQ ID NO: 1007, SEQ ID NO: 1008, SEQ ID NO: 1009 or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1004, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1005, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1006, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1007, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1008, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 agent comprises the amino acid sequence of any of SEQ ID NOs: 1004-1009, or a functional fragment thereof. In an embodiment, the IL-2 agent comprises the amino acid sequence of SEQ ID NO: 1007 or 1008, or a functional fragment thereof. In an embodiment, the IL-2 agent comprises the amino acid sequence of SEQ ID NO: 1004, or a functional fragment thereof. In an embodiment, the IL-2 agent comprises the amino acid sequence of SEQ ID NO: 1005, or a functional fragment thereof. In an embodiment, the IL-2 agent comprises the amino acid sequence of SEQ ID NO: 1006, or a functional fragment thereof. In an embodiment, the IL-2 agent comprises the amino acid sequence of SEQ ID NO:

1007, or a functional fragment thereof. In an embodiment, the IL-2 agent comprises the amino acid sequence of SEQ ID NO: 1008, or a functional fragment thereof. In an embodiment, the IL-2 agent comprises the amino acid sequence of SEQ ID NO: 1009, or a functional fragment thereof.

Without wishing to be bound by theory, it is also believed that in an embodiment, an IL-2 fusion protein comprising the amino acid sequence of SEQ ID NO: 1008, or a functional fragment thereof, can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; (v) has reduced incorrect disulfide pairing and improved stability, e.g., due to the presence of the C125S mutation; and/or (vi) has reduced effector function, e.g., by reduced Fc glycosylation due to the N297G mutation in the Fc region. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 fusion protein comprising the amino acid sequence of SEQ ID NO: 1008 particularly suitable for treating disorders and conditions arising from abnormal immune responses.

Thus, in an embodiment, an IL-2 fusion protein comprising the amino acid sequence SEQ ID NO: 1008, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, or 50 amino acids thereto, has inter alia one or more (e.g., 2, 3, 4, 5, 6, 7, 8, or all) of the following properties relative to a wild-type IL-2 or a reference IL-2 fusion protein that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 fusion protein for the heterodimeric IL-2 receptor composed of human CD122 and human CD132 (i.e. human CD122/CD132 heterodimer) in vitro and/or in vivo; (v) reduced or decreased or substantially unchanged binding capacity and/or binding affinity for human CD25 in vitro and/or in vivo; (vi) selective binding to regulatory T cells (e.g. Foxp3$^+$ T cells); (vii) selective activation of the IL-2 signaling pathway in T regulatory cells (Tregs) in vitro or in vivo; (viii) enhanced or increased ability to induce or promote Treg expansion, activity, survival and/or proliferation; or (ix) reduced or decreased effector function.

In an embodiment, the IL-2 fusion protein comprises from N-terminus to C-terminus an IL-2 variant described herein and an Fc region (e.g., Fc region described herein). In an embodiment, the fusion protein further comprises a linker (e.g., a linker described herein) between the IL-2 variant and the Fc region. In an embodiment the IL-2 fusion forms a dimer, e.g., a homodimer.

In an embodiment, the fusion protein comprises one or more glycosylation sites, or is glycosylated. In another embodiment, the fusion protein does not have a glycosylation site, or is not glycosylated.

In an embodiment, the only amino acids in the fusion protein are canonical amino acids. In an embodiment, the fusion protein comprises naturally-occurring amino acids; analogs, derivatives and congeners thereof; amino acid analogs having variant side chains; and/or all stereoisomers of any of any of the foregoing. The fusion protein may comprise the D- or L-optical isomers of amino acids and peptidomimetics.

In an aspect, this disclosure provides a method of making an IL-2 fusion protein disclosed herein. The IL-2 fusion proteins described herein can be produced by any suitable recombinant DNA technique. In an embodiment, the method includes culturing a cell containing a nucleic acid encoding the IL-2 fusion protein under conditions that allow production of the fusion protein. In another embodiment, the method further includes isolating or purifying the IL-2 fusion protein. In yet another embodiment, the method further includes evaluating efficacy of the IL-2 fusion protein in a cell-based assay or in an animal model. In still another embodiment, the method further includes administering the IL-2 fusion protein to a subject, e.g., a human.

This disclosure provides an isolated nucleic acid molecule encoding an IL-2 fusion protein described herein, and vectors and host cells thereof. The nucleic acid molecule includes, but is not limited to, RNA, genomic DNA and cDNA.

IL-2 Complexes

In an embodiment, the IL-2 agent comprises an IL-2 complex, e.g., an IL-2 complex described herein. In an embodiment, the IL-2 complex is an IL-2/anti-IL-2 antibody immune complex (IL-2 ic).

Without wishing to be bound by theory, it is believed that in an embodiment, IL-2 complexes, such as IL-2/anti-IL-2 antibody immune complexes, can potentiate biologic activity of IL-2 in vivo. For example, the effect of IL-2 on cells (e.g., Tregs) can be modulated by complexing IL-2 with distinct mAbs that specifically bind IL-2. The mechanisms can include, e.g., the prolongation of the cytokine half-life in circulation. Depending on the clone of IL-2 antibody, IL-2 ic can selectively stimulate, for example, CD25high cells (e.g., IL-2/JES6-1 immune complexes), or CD122high cells (e.g., IL-2/S4B6 immune complexes). For example, IL-2/JES6-1 immune complexes highly selectively stimulate regulatory T cells and they can be useful for transplantations and in treatment of autoimmune diseases. As another example, IL-2/S4B6 immune complexes can have high stimulatory activity for NK cells and memory CD8+ T cells and they can replace the conventional IL-2 in cancer immunotherapy.

In an embodiment, the IL-2 complex comprises an IL-2 variant described herein. In an embodiment, the IL-2 complex comprises one or more amino acid alterations (e.g., substitutions) described in Table 9. In an embodiment, the IL-2 complex comprises an amino acid sequence described in Table 9, or a functional fragment thereof. In an embodiment, the IL-2 complex comprises an anti-IL-2 antibody molecule. In an embodiment, the IL-2 complex comprises an IL-2 variant described herein and an anti-IL-2 antibody molecule. In an embodiment, the anti-IL-2 antibody molecule binds to the IL-2 variant. In an embodiment, the anti-IL-2 antibody molecule is capable of binding to the IL-2 variant and the wild-type IL-2. In an embodiment, the IL-2 variant comprises one or more mutations described herein.

In an embodiment, the one or more mutations does not reduce, or does not substantially reduce, binding of the IL-2 variant to an anti-IL-2 antibody molecule.

In an embodiment, the IL-2 complex comprises an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 complex modulates (e.g., stimulates) one or more activities of T cells. In an embodiment, the IL-2 complex stimulates CD25high cells. In an embodiment, the IL-2 complex stimulates Tregs. In an embodiment, the IL-2 complex stimulates CD122high cells. In an embodiment, the IL-2 complex stimulates NK cells and/or memory CD8+ T cells. In an embodiment, the IL-2 complex selectively stimulates CD25high cells over CD122high cells. In an embodiment, the IL-2 complex selectively stimulates CD122high cells over CD25high cells. In an embodiment, the IL-2 complex selectively stimulates Tregs over NK cells and/or memory CD8+ T cells. In an embodiment, the IL-2 complex selectively stimulates NK cells and/or memory CD8+ T cells over Tregs.

Exemplary anti-IL-2 antibody molecules suitable for use are described, e.g., in International Application Publication No. WO 2016/164937, which is incorporated herein by reference in its entirety.

As used herein, the term "antibody molecule" refers to a protein, e.g., an immunoglobulin chain or a fragment thereof, comprising at least one immunoglobulin variable domain sequence. The term "antibody molecule" includes, for example, full-length, mature antibodies and antigen-binding fragments of an antibody. For example, an antibody molecule can include a heavy (H) chain variable domain sequence (abbreviated herein as VH), and a light (L) chain variable domain sequence (abbreviated herein as VL). In another example, an antibody molecule includes two heavy (H) chain variable domain sequences and two light (L) chain variable domain sequence, thereby forming two antigen binding sites, such as Fab, Fab', F(ab')2, Fc, Fd, Fd', Fv, single chain antibodies (scFv for example), single variable domain antibodies, diabodies (Dab) (bivalent and bispecific), and chimeric (e.g., humanized) antibodies, which may be produced by the modification of whole antibodies or those synthesized de novo using recombinant DNA technologies. These functional antibody fragments retain the ability to selectively bind with their respective antigen or receptor. Antibodies and antibody fragments can be from any class of antibodies including, but not limited to, IgG, IgA, IgM, IgD, and IgE, and from any subclass (e.g., IgG1, IgG2, IgG3, and IgG4) of antibodies. The antibody molecules can be monoclonal or polyclonal. The antibody molecule can also be a human, humanized, CDR-grafted, or in vitro generated antibody. The antibody molecule can have a heavy chain constant region chosen from, e.g., IgG1, IgG2, IgG3, or IgG4. The antibody molecule can also have a light chain chosen from, e.g., kappa or lambda. The term "immunoglobulin" (Ig) is used interchangeably with the term "antibody" herein.

Examples of antigen-binding fragments include: (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a diabody (dAb) fragment, which consists of a VH domain; (vi) a camelid or camelized variable domain; (vii) a single chain Fv (scFv), see e.g., Bird et al. (1988) *Science* 242:423-426; and Huston et al. (1988) *Proc. Natl. Acad. Sci. USA* 85:5879-5883); (viii) a single domain antibody. These antibody fragments may be obtained using any suitable method, including several conventional techniques known to those with skill in the art, and the fragments can be screened for utility in the same manner as are intact antibodies.

The term "antibody" includes intact molecules as well as functional fragments thereof. Constant regions of the antibodies can be altered, e.g., mutated, to modify the properties of the antibody (e.g., to increase or decrease one or more of: Fc receptor binding, antibody glycosylation, the number of cysteine residues, effector cell function, or complement function).

The antibody molecule can be a single chain antibody. A single-chain antibody (scFV) may be engineered (see, for example, Colcher, D. et al. (1999) *Ann N Y Acad Sci* 880:263-80; and Reiter, Y. (1996) *Clin Cancer Res* 2:245-52). The single chain antibody can be dimerized or multimerized to generate multivalent antibodies having specificities for different epitopes of the same target protein.

The antibody molecules disclosed herein can also be single domain antibodies. Single domain antibodies can include antibodies whose complementary determining regions are part of a single domain polypeptide. Examples include, but are not limited to, heavy chain antibodies, antibodies naturally devoid of light chains, single domain antibodies derived from conventional 4-chain antibodies, engineered antibodies and single domain scaffolds other than those derived from antibodies. Single domain antibodies may be any of the art, or any future single domain antibodies. Single domain antibodies may be derived from any species including, but not limited to mouse, human, camel, llama, fish, shark, goat, rabbit, and bovine. According to some aspects, a single domain antibody is a naturally occurring single domain antibody known as heavy chain antibody devoid of light chains. Such single domain antibodies are disclosed in WO 94/04678, for example. For clarity reasons, this variable domain derived from a heavy chain antibody naturally devoid of light chain is known herein as a VHH or nanobody to distinguish it from the conventional VH of four chain immunoglobulins. Such a VHH molecule can be derived from antibodies raised in Camelidae species, for example in camel, llama, dromedary, alpaca and guanaco. Other species besides Camelidae may produce heavy chain antibodies naturally devoid of light chain; such VHHs are also contemplated.

The VH and VL regions can be subdivided into regions of hypervariability, termed "complementarity determining regions" (CDR), interspersed with regions that are more conserved, termed "framework regions" (FR or FW). The terms "complementarity determining region," and "CDR," as used herein refer to the sequences of amino acids within antibody variable regions which confer antigen specificity and binding affinity. As used herein, the terms "framework," "FW" and "FR" are used interchangeably.

The extent of the framework region and CDRs has been precisely defined by a number of methods (see, Kabat, E. A., et al. (1991) Sequences of Proteins of Immunological Interest, Fifth Edition, U.S. Department of Health and Human Services, NIH Publication No. 91-3242; Chothia, C. et al. (1987) *J. Mol. Biol.* 196:901-917; and the AbM definition used by Oxford Molecular's AbM antibody modeling software. See, generally, e.g., Protein Sequence and Structure Analysis of Antibody Variable Domains. In: Antibody Engineering Lab Manual (Ed.: Duebel, S. and Kontermann, R., Springer-Verlag, Heidelberg). In an embodiment, the following definitions are used: AbM definition of CDR1 of the heavy chain variable domain and Kabat definitions for the other CDRs. In an embodiment, Kabat definitions are used for all CDRs. In addition, embodiments described with respect to Kabat or AbM CDRs may also be implemented using Chothia hypervariable loops. Each VH and VL typically includes three CDRs and four FRs, arranged from amino-terminus to carboxy-terminus in the following order: FR1, CDR1, FR2, CDR2, FR3, CDR3, and FR4.

As used herein, an "immunoglobulin variable domain sequence" refers to an amino acid sequence which can form the structure of an immunoglobulin variable domain. For example, the sequence may include all or part of the amino acid sequence of a naturally-occurring variable domain. For example, the sequence may or may not include one, two, or more N- or C-terminal amino acids or may include other alterations that are compatible with formation of the protein structure.

The term "antigen-binding region" refers to the part of an antibody molecule that comprises determinants that form an interface that binds to an antigen, or an epitope thereof. With respect to proteins (or protein mimetics), the antigen-binding region typically includes one or more loops (of at least, e.g., four amino acids or amino acid mimics) that form an interface that binds to the antigen. Typically, the antigen-binding region of an antibody molecule includes at least one or two CDRs and/or hypervariable loops, or more typically at least three, four, five or six CDRs and/or hypervariable loops.

The terms "compete" or "cross-compete" are used interchangeably herein to refer to the ability of an antibody molecule to interfere with binding of another antibody molecule to a target. The interference with binding can be direct or indirect (e.g., through an allosteric modulation of the antibody molecule or the target). The extent to which an antibody molecule is able to interfere with the binding of another antibody molecule to the target, and therefore whether it can be said to compete, can be determined using a competition binding assay, for example, a FACS assay, an ELISA or BIACORE assay. In an embodiment, a competition binding assay is a quantitative competition assay. In an embodiment, a first antibody molecule is said to compete for binding to the target with a second antibody molecule when the binding of the first antibody molecule to the target is reduced by 10% or more, e.g., 20% or more, 30% or more, 40% or more, 50% or more, 55% or more, 60% or more, 65% or more, 70% or more, 75% or more, 80% or more, 85% or more, 90% or more, 95% or more, 98% or more, 99% or more in a competition binding assay (e.g., a competition assay described herein).

The terms "monoclonal antibody" or "monoclonal antibody composition" as used herein refer to a preparation of antibody molecules of single molecular composition. A monoclonal antibody composition displays a single binding specificity and affinity for a particular epitope. A monoclonal antibody can be made by hybridoma technology or by methods that do not use hybridoma technology (e.g., recombinant methods).

An "effectively human" protein is a protein that does not evoke a neutralizing antibody response, e.g., the human anti-murine antibody (HAMA) response. HAMA can be problematic in a number of circumstances, e.g., if the antibody molecule is administered repeatedly, e.g., in treatment of a chronic or recurrent disease condition. A HAMA response can make repeated antibody administration potentially ineffective because of an increased antibody clearance from the serum (see, e.g., Saleh et al., *Cancer Immunol. Immunother.* 32:180-190 (1990)) and also because of potential allergic reactions (see, e.g., LoBuglio et al., *Hybridoma,* 5:5117-5123 (1986)).

The antibody molecule can be a polyclonal or a monoclonal antibody. In an embodiment, the antibody can be recombinantly produced, e.g., produced by any suitable phage display or combinatorial methods.

Various phage display and combinatorial methods for generating antibodies are known in the art (as described in, e.g., Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) *Bio/Technology* 9:1370-1372; Hay et al. (1992) *Hum Antibod Hybridomas* 3:81-85; Huse et al. (1989) *Science* 246:1275-1281; Griffiths et al. (1993) *EMBO J* 12:725-734; Hawkins et al. (1992) *J Mol Biol* 226:889-896; Clackson et al. (1991) *Nature* 352:624-628; Gram et al. (1992) PNAS 89:3576-3580; Garrad et al. (1991) *Bio/Technology* 9:1373-1377; Hoogenboom et al. (1991) *Nuc Acid Res* 19:4133-4137; and Barbas et al. (1991) *PNAS* 88:7978-7982, the contents of all of which are incorporated by reference herein).

In an embodiment, the antibody molecule is a fully human antibody (e.g., an antibody made in a mouse which has been genetically engineered to produce an antibody from a human immunoglobulin sequence), or a non-human antibody, e.g., a rodent (mouse or rat), goat, primate (e.g., monkey), camel antibody. In an embodiment, the non-human antibody is a rodent (mouse or rat antibody). Methods of producing rodent antibodies are known in the art.

Human monoclonal antibodies can be generated using transgenic mice carrying the human immunoglobulin genes rather than the mouse system. Splenocytes from these transgenic mice immunized with the antigen of interest are used to produce hybridomas that secrete human mAbs with specific affinities for epitopes from a human protein (see e.g., Wood et al. International Application WO 91/00906, Kucherlapati et al. PCT publication WO 91/10741; Lonberg et al. International Application WO 92/03918; Kay et al. International Application 92/03917; Lonberg et al. 1994 *Nature* 368:856-859; Green, L. L. et al. 1994 *Nature Genet.* 7:13-21; Morrison, S. L. et al. 1994 *Proc. Natl. Acad. Sci. USA* 81:6851-6855; Bruggeman et al. 1993 Year *Immunol* 7:33-40; Tuaillon et al. 1993 *PNAS* 90:3720-3724; Bruggeman et al. 1991 *Eur J Immunol* 21:1323-1326).

An antibody can be one in which the variable region, or a portion thereof, e.g., the CDRs, are generated in a non-human organism, e.g., a rat or mouse. Chimeric, CDR-grafted, and humanized antibodies are within the invention. Antibodies generated in a non-human organism, e.g., a rat or mouse, and then modified, e.g., in the variable framework or constant region, to decrease antigenicity in a human are within the invention.

Chimeric antibodies can be produced by any suitable recombinant DNA technique. Several are known in the art (see Robinson et al., International Patent Publication PCT/US86/02269; Akira, et al., European Patent Application 184,187; Taniguchi, M., European Patent Application 171, 496; Morrison et al., European Patent Application 173,494; Neuberger et al., International Application WO 86/01533; Cabilly et al. U.S. Pat. No. 4,816,567; Cabilly et al., European Patent Application 125,023; Better et al. (1988 *Science* 240:1041-1043); Liu et al. (1987) *PNAS* 84:3439-3443; Liu et al., 1987, *J. Immunol.* 139:3521-3526; Sun et al. (1987) *PNAS* 84:214-218; Nishimura et al., 1987, *Canc. Res.* 47:999-1005; Wood et al. (1985) *Nature* 314:446-449; and Shaw et al., 1988, *J. Natl Cancer Inst.* 80:1553-1559).

A humanized or CDR-grafted antibody will have at least one or two but generally all three recipient CDRs (of heavy and or light immunoglobulin chains) replaced with a donor CDR. The antibody may be replaced with at least a portion of a non-human CDR or only some of the CDRs may be replaced with non-human CDRs. It is only necessary to replace the number of CDRs required for binding of the humanized antibody to lipopolysaccharide. In an embodiment, the donor will be a rodent antibody, e.g., a rat or mouse antibody, and the recipient will be a human framework or a human consensus framework. Typically, the immunoglobulin providing the CDRs is called the "donor" and the immunoglobulin providing the framework is called the "acceptor." In an embodiment, the donor immunoglobulin is a non-human (e.g., rodent). The acceptor framework is typically a naturally-occurring (e.g., a human) framework or a consensus framework, or a sequence about 85% or higher, e.g., 90%, 95%, 99% or higher identical thereto.

As used herein, the term "consensus sequence" refers to the sequence formed from the most frequently occurring amino acids (or nucleotides) in a family of related sequences (See e.g., Winnaker, From Genes to Clones (Verlagsgesellschaft, Weinheim, Germany 1987). In a family of proteins, each position in the consensus sequence is occupied by the amino acid occurring most frequently at that position in the family. If two amino acids occur equally frequently, either can be included in the consensus sequence. A "consensus framework" refers to the framework region in the consensus immunoglobulin sequence.

An antibody can be humanized by any suitable method, and several such methods known in the art (see e.g., Morrison, S. L., 1985, *Science* 229:1202-1207, by Oi et al., 1986, *BioTechniques* 4:214, and by Queen et al. U.S. Pat. Nos. 5,585,089, 5,693,761 and 5,693,762, the contents of all of which are hereby incorporated by reference).

Humanized or CDR-grafted antibodies can be produced by CDR-grafting or CDR substitution, wherein one, two, or all CDRs of an immunoglobulin chain can be replaced. See e.g., U.S. Pat. No. 5,225,539; Jones et al. 1986 *Nature* 321:552-525; Verhoeyan et al. 1988 *Science* 239:1534; Beidler et al. 1988 *J. Immunol.* 141:4053-4060; Winter U.S. Pat. No. 5,225,539, the contents of all of which are hereby expressly incorporated by reference. Winter describes a CDR-grafting method which may be used to prepare humanized antibodies (UK Patent Application GB 2188638A, filed on Mar. 26, 1987; Winter U.S. Pat. No. 5,225,539), the contents of which is expressly incorporated by reference.

Also provided are humanized antibodies in which specific amino acids have been substituted, deleted or added. Criteria for selecting amino acids from the donor are described in, e.g., U.S. Pat. No. 5,585,089, e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

In an embodiment, the antibody molecule has a heavy chain constant region chosen from, e.g., the heavy chain constant regions of IgG1, IgG2 (e.g., IgG2a), IgG3, IgG4, IgM, IgA1, IgA2, IgD, and IgE; particularly, chosen from, e.g., the (e.g., human) heavy chain constant regions of IgG1, IgG2, IgG3, and IgG4. In another embodiment, the antibody molecule has a light chain constant region chosen from, e.g., the (e.g., human) light chain constant regions of kappa or lambda. The constant region can be altered, e.g., mutated, to modify the properties of the antibody molecule (e.g., to increase or decrease one or more of: Fc receptor binding, antibody glycosylation, the number of cysteine residues, effector cell function, and/or complement function). In an embodiment, the antibody molecule has effector function and can fix complement. In another embodiment, the antibody molecule does not recruit effector cells or fix complement. In certain embodiments, the antibody molecule has reduced or no ability to bind an Fc receptor. For example, it may be an isotype or subtype, fragment or other mutant, which does not support binding to an Fc receptor, e.g., it has a mutagenized or deleted Fc receptor binding region.

In an embodiment, a constant region of the antibody molecule is altered. Methods for altering an antibody constant region are known in the art. Antibody molecules s with altered function, e.g. altered affinity for an effector ligand, such as FcR on a cell, or the C1 component of complement can be produced by replacing at least one amino acid residue in the constant portion of the antibody with a different residue (see e.g., EP 388,151 A1, U.S. Pat. Nos. 5,624,821 and 5,648,260, the contents of all of which are hereby incorporated by reference). Amino acid mutations which stabilize antibody structure, such as S228P (EU nomenclature, S241P in Kabat nomenclature) in human IgG4 are also contemplated. Similar type of alterations could be described which if applied to the murine, or other species immunoglobulin would reduce or eliminate these functions.

In an embodiment, the only amino acids in the antibody molecule are canonical amino acids. In an embodiment, the antibody molecule comprises naturally-occurring amino acids; analogs, derivatives and congeners thereof; amino acid analogs having variant side chains; and/or all stereoisomers of any of any of the foregoing. The antibody molecule may comprise the D- or L-optical isomers of amino acids and peptidomimetics.

A polypeptide of an antibody molecule described herein may be linear or branched, it may comprise modified amino acids, and it may be interrupted by non-amino acids. The antibody molecule may also be modified; for example, by disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

The antibody molecule described herein can be used alone in unconjugated form, or can be bound to a substance, e.g., a toxin or moiety (e.g., a therapeutic drug; a compound emitting radiation; molecules of plant, fungal, or bacterial origin; or a biological protein (e.g., a protein toxin) or particle (e.g., a recombinant viral particle, e.g., via a viral coat protein). For example, the antibody molecule can be coupled to a radioactive isotope such as an α-, β-, or γ-emitter, or a β- and γ-emitter.

An antibody molecule can be derivatized or linked to another functional molecule (e.g., another peptide or protein). As used herein, a "derivatized" antibody molecule is one that has been modified. Methods of derivatization include but are not limited to the addition of a fluorescent moiety, a radionucleotide, a toxin, an enzyme or an affinity ligand such as biotin. Accordingly, the antibody molecules are intended to include derivatized and otherwise modified forms of the antibodies described herein, including immunoadhesion molecules. For example, an antibody molecule can be functionally linked (by chemical coupling, genetic fusion, noncovalent association or otherwise) to one or more other molecular entities, such as another antibody (e.g., a bispecific antibody or a diabody), a detectable agent, a toxin, a pharmaceutical agent, and/or a protein or peptide that can mediate association of the antibody or antibody portion with another molecule (such as a streptavidin core region or a polyhistidine tag).

Some types of derivatized antibody molecule are produced by crosslinking two or more antibodies (of the same type or of different types, e.g., to create bispecific antibodies). Suitable crosslinkers include those that are heterobifunctional, having two distinctly reactive groups separated by an appropriate spacer (e.g., m-maleimidobenzoyl-N-hydroxysuccinimide ester) or homobifunctional (e.g., disuccinimidyl suberate). Such linkers are available from Pierce Chemical Company, Rockford, Ill.

Useful detectable agents with which an anti-dengue antibody molecule may be derivatized (or labeled) to include fluorescent compounds, various enzymes, prosthetic groups, luminescent materials, bioluminescent materials, fluorescent emitting metal atoms, e.g., europium (Eu), and other anthanides, and radioactive materials (described below). Exemplary fluorescent detectable agents include fluorescein, fluorescein isothiocyanate, rhodamine, 5dimethylamine-1-napthalenesulfonyl chloride, phycoerythrin and the like. An antibody may also be derivatized with detectable enzymes, such as alkaline phosphatase, horseradish peroxidase, β-galactosidase, acetylcholinesterase, glucose oxidase and the like. When an antibody is derivatized with a detectable enzyme, it is detected by adding additional reagents that the enzyme uses to produce a detectable reaction product. For example, when the detectable agent horseradish peroxidase is present, the addition of hydrogen peroxide and diaminobenzidine leads to a colored reaction product, which is detectable. An antibody molecule may also be derivatized with a prosthetic group (e.g., streptavidin/biotin and avidin/biotin). For example, an antibody may be derivatized with biotin, and detected through indirect measurement of avidin or streptavidin binding. Examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; and examples of bioluminescent materials include luciferase, luciferin, and aequorin.

Labeled antibody molecules can be used, for example, diagnostically and/or experimentally in a number of contexts, including (i) to isolate a predetermined antigen by standard techniques, such as affinity chromatography or immunoprecipitation; (ii) to detect a predetermined antigen (e.g., in a cellular lysate or cell supernatant) in order to evaluate the abundance and pattern of expression of the protein; (iii) to monitor protein levels in tissue as part of a clinical testing procedure, e.g., to determine the efficacy of a given treatment regimen.

An antibody molecule may be conjugated to another molecular entity, typically a label or a therapeutic (e.g., antimicrobial (e.g., antibacterial or bactericidal), immunomodulatory, immunostimularoty, cytotoxic, or cytostatic) agent or moiety. Radioactive isotopes can be used in diagnostic or therapeutic applications. Radioactive isotopes that can be coupled to the antibody molecules include, but are not limited to $\alpha$-, $\beta$-, or $\gamma$-emitters, or $\beta$- and $\gamma$-emitters. Such radioactive isotopes include, but are not limited to iodine ($^{131}$I or $^{125}$I), yttrium ($^{90}$Y), lutetium ($^{177}$Lu), actinium ($^{225}$Ac), praseodymium, astatine ($^{211}$At), rhenium ($^{186}$Re), bismuth ($^{212}$Bi or $^{213}$Bi), indium ($^{111}$In), technetium ($^{99}$mTc), phosphorus ($^{32}$P), rhodium ($^{188}$Rh), sulfur ($^{35}$S), carbon ($^{14}$C), tritium ($^{3}$H), chromium ($^{51}$Cr), chlorine ($^{36}$Cl), cobalt ($^{57}$Co or $^{58}$Co), iron ($^{59}$Fe), selenium ($^{75}$Se), or gallium ($^{67}$Ga). Radioisotopes useful as therapeutic agents include yttrium ($^{90}$Y), lutetium ($^{177}$Lu), actinium ($^{225}$Ac), praseodymium, astatine ($^{211}$At), rhenium ($^{186}$Re), bismuth ($^{212}$Bi or $^{213}$Bi), and rhodium ($^{188}$Rh). Radioisotopes useful as labels, e.g., for use in diagnostics, include iodine ($^{131}$I or $^{125}$I), indium ($^{111}$In), technetium ($^{99}$mTc), phosphorus ($^{32}$P), carbon ($^{14}$C), and tritium ($^{3}$H), or one or more of the therapeutic isotopes listed above.

In an aspect, this disclosure provides a method of making an IL-2 complex described herein. The method includes, e.g., contacting an IL-2 variant described herein with an anti-IL-2 antibody molecule (e.g., an anti-IL-2 antibody molecule that binds to the IL-2 variant), to thereby producing the IL-2 complex. In an embodiment, the method further comprises evaluating the efficacy of the IL-2 complex in vitro, ex vivo, or in vivo.

This disclosure provides an isolated nucleic acid molecule encoding an IL-2 complex (or a portion thereof) described herein, and vectors and host cells thereof. The nucleic acid molecule includes, but is not limited to, RNA, genomic DNA and cDNA.

IL-2 Conjugates

In an embodiment, the IL-2 agent comprises a conjugate, e.g., an IL-2 conjugate described herein.

In an embodiment, the IL-2 conjugate comprises an IL-2 variant described herein and a non-IL-2 moiety. In an embodiment, the IL-2 conjugate comprises one or more amino acid alterations (e.g., substitutions) described in Table 9. In an embodiment, the IL-2 conjugate comprises an amino acid sequence described in Table 9, or a functional fragment thereof. In an embodiment, the non-IL-2 moiety comprises an antibody molecule, e.g., an antibody molecule described herein. In an embodiment, the non-IL-2 moiety comprises a polymer, e.g., a polyether compound. In an embodiment, the polyether compound comprises polyethylene glycol (PEG). In an embodiment, the non-IL-2 moiety comprises a cytokine. The IL-2 variant can be coupled to the non-IL-2 moiety directly, or indirectly, e.g., through a linker. In an embodiment, the IL-2 conjugate is an IL-2 fusion protein.

In an embodiment, the IL-2 conjugate comprises an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 conjugate is an immunoconjugate, e.g., comprising an antibody molecule. In an embodiment, the IL-2 variant is coupled to the antibody molecule by a covalent bond. In an embodiment, the IL-2 variant is coupled to the antibody molecule by a peptide bond. In an embodiment, the IL-2 variant and the antibody molecule forms a fusion protein. In an embodiment, the fusion protein comprises a linker between the IL-2 variant and the antibody molecule (e.g., a heavy chain, a light chain, or both). In an embodiment, the IL-2 variant is coupled to the antibody molecule by a non-peptide bond. In an embodiment, the IL-2 variant is not coupled to the antibody molecule by a non-peptide bond.

In an embodiment, the IL-2 variant is coupled to the backbone of the antibody molecule. In another embodiment, the IL-2 variant is coupled to a side chain of the antibody molecule. In an embodiment, the antibody molecule is coupled to the backbone of the IL-2 variant. In an embodiment, the antibody molecule is coupled to a side-chain of the IL-2 variant.

In an embodiment, two or more (e.g., three, four, five, six, seven, eight, or more) IL-2 variants are coupled to the antibody molecule. In an embodiment, four IL-2 variants are coupled to the antibody molecule. For example, the IL-2 variants can be the same, or at least some of the IL-2 variants are different from each other. In an embodiment, the IL-2 variant is coupled to the antibody molecule in a bivalent manner. In another embodiment, the IL-2 variant is coupled to the antibody molecule in a tetravalent manner.

In an embodiment, the IL-2 conjugate is produced by enzymatic synthesis. For example, IL-2 conjugates can be produced by chemical synthesis of an IL-2 variant, expression of an antibody molecule, and enzymatic ligation of the IL-2 variant to the antibody molecule. In an embodiment, 90% or more, e.g., 92% or more, 95% or more, 97% or more, or 99% or more, reaction efficiency is achieved. In another embodiment, the method further comprises purifying the ADC. In an embodiment, the yield is 60% or more (e.g., 70% or more, 75% or more, 80% or more, 90% or more, or 95% or more) after purification.

In an aspect, the disclosure provides a combination of (a) an immunoconjugate comprising a first antibody molecule having a reduced effector function and an IL-2 variant described herein, and (b) a second antibody molecule having an increased effector function, for use in treating a disorder, e.g., a disorder described herein.

In an embodiment, the reduced effector function of the first antibody comprises reduced binding to an activating Fc receptor, reduced ADCC, reduced ADCP, reduced CDC, reduced cytokine secretion, or a combination thereof. In an embodiment, the reduced effector function is reduced binding to an activating Fc receptor, e.g., a human Fc receptor. In an embodiment, the activating Fc receptor is an Fc$\gamma$ receptor. In an embodiment, the activating Fc receptor is Fc$\gamma$RIIIa, Fc$\gamma$RI, or Fc$\gamma$RIIa. In an embodiment, the reduced effector function comprises reduced ADCC. In an embodiment, the increased effector function comprises reduced binding to an activating Fc receptor and reduced ADCC.

In an embodiment, the first antibody molecule comprises one or more amino acid mutations (e.g., substitutions) in the Fc region as described herein. In an embodiment, the first antibody molecule comprises an amino acid substitution at position P329 of an immunoglobulin heavy chain. In an embodiment, the amino acid substitution comprises P329A or P329G, e.g., P329G. In an embodiment, the antibody molecule comprises a further amino acid substitution at a position of S228, E233, L234, L235, N297, P331, or a combination thereof, of an immunoglobulin heavy chain. In an embodiment, the further amino acid substitution comprises S228P, E233P, L234A, L235A, L235E, N297A, N297D, P331S, or a combination thereof. In a particular embodiment the antibody comprises amino acid substitutions at positions P329, L234 and L235 of an immunoglobulin heavy chain. In an embodiment, the amino acid substitutions comprise L234A, L235A and P329G (LALA P329G).

In an embodiment, the first antibody molecule is directed to an antigen presented on a tumor cell or in a tumor cell environment. In an embodiment, the first antibody is directed to an antigen chosen from Fibroblast Activation Protein (FAP), the A1 domain of Tenascin-C(TNC A1), the A2 domain of Tenascin-C(TNC A2), the Extra Domain B of Fibronectin (EDB), Carcinoembryonic Antigen (CEA), and Melanoma-associated Chondroitin Sulfate Proteoglycan (MCSP).

In an embodiment the increased effector function of the second antibody molecule comprises increased binding to an activating Fc receptor, increased ADCC, increased ADCP, increased CDC, increased cytokine secretion, or a combination thereof. In an embodiment, the increased effector function comprises increased binding to an activating Fc receptor. In an embodiment, the activating Fc receptor is FcγRIIIa, FcγRI, or FcγRIIa. In an embodiment, the increased effector function comprises increased ADCC. In an embodiment, the increased effector function comprises increased binding to an activating Fc receptor and increased ADCC.

In an embodiment, the second antibody molecule comprises one or more amino acid mutations (e.g., substitutions) in the Fc region. In an embodiment, the second antibody molecule comprises a modification of the glycosylation in the Fc region. In an embodiment, the modification of the glycosylation in the Fc region comprises an increased proportion of non-fucosylated oligosaccharides in the Fc region (e.g., increased to at least 20%, 30%, 40%, 50%, 60%, 70%, 80%, or 90%) as compared to a non-modified antibody molecule. In an embodiment, the modification comprises an increased proportion of bisected oligosaccharides in the Fc region (e.g., increased to at least 20%, 30%, 40%, 50%, 60%, 70%, 80%, or 90%), as compared to a non-modified antibody molecule. In an embodiment, the modification of the glycosylation in the Fc region comprises an increased proportion of bisected, non-fucosylated oligosaccharides in the Fc region (e.g., increased to at least 20%, 30%, 40%, 50%, 60%, 70%, 80%, or 90%), as compared to a non-modified antibody molecule.

In an embodiment, the second antibody molecule is directed to an antigen presented on a tumor cell. In an embodiment, the second antibody molecule is directed to an antigen chosen from CD20, Epidermal Growth Factor Receptor (EGFR), HER2, HER3, Insulin-like Growth Factor 1 Receptor (IGF-1R), c-Met, CUB domain-containing protein-1 (CDCP1), Carcinoembryonic Antigen (CEA) and Melanoma-associated Chondroitin Sulfate Proteoglycan (MCSP).

In an embodiment, the disease is a disorder treatable by stimulation of effector cell function. In an aspect, the disclosure provides a composition comprising: (a) an immunoconjugate comprising a first antibody molecule having a reduced effector function and an IL-2 variant described herein, (b) a second antibody molecule having an increased effector function, and (c) a pharmaceutically acceptable carrier.

IL-2 Receptors

The IL-2 agents (e.g., IL-2 variants, IL-2 fusion proteins, IL-2 complexes, or IL-2 conjugates) described herein can bind to an IL-2 receptor (IL-2R) and/or modulate one or more functions associated with an IL-2R.

IL-2R is a heterotrimeric protein expressed on the surface of certain immune cells, such as lymphocytes, that binds and responds to IL-2. IL-2 receptor typically has three forms, generated by different combinations of three different chains: α (alpha) (also known as IL-2Rα, CD25, or Tac antigen), β (beta) (also known as IL-2Rβ, or CD122), and γ (gamma) (also known as IL-2Rγ, γc, common gamma chain, or CD132).

The IL-2R chains are expressed separately and differently on various cell types and can assemble in different combinations and orders to generate low, intermediate, and high affinity IL-2Rs. IL-2Rα binds IL-2 with low affinity; IL-2Rβ and IL-2Rγ together form a complex that binds IL-2 with intermediate affinity (e.g., on memory T cells and NK cells); and IL-2Rα, IL-2Rβ, and IL-2Rγ together form a complex that binds IL-2 with high affinity (e.g., on activated T cells and regulatory T cells).

IL-2Rβ and IL-2Rγ complex with Janus kinase 1 (JAK1) and Janus kinase 3 (JAK3), respectively. The binding of IL-2 to IL-2R can activate JAK1/JAK2 and initiate downstream intracellular signaling, e.g., the MAP kinase pathway, the Phosphoinositide 3-kinase (PI3K) pathway, or the JAK-STAT pathway (Liao et al., *Curr Opin Immunol.* 2011; 23 (5): 598-604; Malek and Castro. *Immunity.* 2010; 33 (2): 153-165).

IL-2R plays important roles in the immune system, tolerance and immunity. For example, the interaction between IL-2 and IL-2R is involved in promoting the differentiation of certain immature T cells into regulatory T cells, and the differentiation of T cells into effector T cells and into memory T cells. The interaction between IL-2 and IL-2R is also associated with autoimmune diseases, infections, and cell-mediated immunity.

In an aspect, the disclosure provides IL-2 agents comprising an IL-2 variant described herein that has an altered binding affinity to an IL-2R, e.g., one, two, or all of IL-2Rα, IL-2Rβ, or IL-2Rγ. For example, the IL-2 variant can have one or more (e.g., two, three, four, five, or more) amino acid alternations (e.g., substitutions or mutations) associated with the interaction between IL-2 and IL-2R, e.g., one, two, or all of IL-2Rα, IL-2Rβ, or IL-2Rγ.

In an embodiment, the IL-2 agent has an altered (e.g., reduced) binding affinity to IL-2Rα. In an embodiment, the binding affinity to IL-2Rα is reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant. In an embodiment, the IL-2 agent has an altered (e.g., reduced) binding affinity to IL-2Rβ. In an embodiment, the binding affinity to IL-2Rβ is reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant. In an embodiment, the IL-2 agent has an altered (e.g., reduced) binding affinity to IL-2Rγ. In an embodiment, the binding affinity to IL-2Rγ is reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the IL-2 agent has an altered (e.g., reduced) binding affinity to IL-2Rα and an altered (e.g., reduced) binding affinity to IL-2Rβ. In an embodiment, the binding affinity to IL-2Rα is reduced by about 10%, 20%, 30%, 40%, 50%, 60%, 70%, 80%, 90%, or more, and the binding affinity to IL-2Rβ is reduced by about 10%, 20%, 30%, 40%, 50%, 60%, 70%, 80%, 90%, or more. In an embodiment, the binding affinities to IL-2Rα and IL-2Rβ are reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the IL-2 agent has an altered (e.g., reduced) binding affinity to IL-2Rα and an altered (e.g., reduced) binding affinity to IL-2Rγ. In an embodiment, the binding affinity to IL-2Rα is reduced by about 10%, 20%, 30%, 40%, 50%, 60%, 70%, 80%, 90%, or more, and the binding affinity to IL-2Rγ is reduced by about 10%, 20%, 30%, 40%, 50%, 60%, 70%, 80%, 90%, or more. In an embodiment, the binding affinities to IL-2Rα and IL-2Rγ are reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the IL-2 agent has an altered (e.g., reduced) binding affinity to IL-2Rβ and an altered (e.g., reduced) binding affinity to IL-2Rγ. In an embodiment, the binding affinity to IL-2Rβ is reduced by about 10%, 20%, 30%, 40%, 50%, 60%, 70%, 80%, 90%, or more, and the binding affinity to IL-2Rγ is reduced by about 10%, 20%, 30%, 40%, 50%, 60%, 70%, 80%, 90%, or more. In an embodiment, the binding affinities to IL-2Rβ and IL-2Rγ are reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the IL-2 agent has an altered (e.g., reduced) binding affinity to IL-2Rα, an altered (e.g., reduced) binding affinity to IL-2Rβ, and an altered (e.g., reduced) binding affinity to IL-2Rγ. In an embodiment, the binding affinity to IL-2Rα is reduced by about 10%, 20%, 30%, 40%, 50%, 60%, 70%, 80%, 90%, or more, the binding affinity to IL-2Rβ is reduced by about 10%, 20%, 30%, 40%, 50%, 60%, 70%, 80%, 90%, or more, and the binding affinity to IL-2Rγ is reduced by about 10%, 20%, 30%, 40%, 50%, 60%, 70%, 80%, 90%, or more. In an embodiment, the binding affinities to IL-2Rα, IL-2Rβ, and IL-2Rγ are reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the binding affinity of an IL-2 agent provided by the disclosure to any of IL-2Rα, IL-2Rβ, or IL-2Rγ is reduced, but not abolished. For example, the reduction can range from about 10% to about 90%, e.g., from about 20% to about 80%, from about 30% to about 70%, from about 40% to about 60%, from about 10% to about 50%, or from about 50% to about 90%, relative to an IL-2 agent comprising a wild-type IL-2 or an IL-2 agent comprising a reference IL-2 variant.

Fc Region

The present disclosure provides IL-2 agents (e.g., IL-2 variants, fusion polypeptides, complexes, or immunoconjugates) comprising an Fc region or a fragment thereof, e.g., an Fc region, or a fragment thereof (e.g., a functional fragment thereof), described herein.

In an embodiment, the IL-2 agent comprises an IL-2 variant described herein and an Fc region described herein. In an embodiment, the IL-2 agent further comprises a linker between the IL-2 variant and the Fc region. In an embodiment, the IL-2 agent comprises an IL-2 fusion protein comprising an Fc region described herein. In an embodiment, the Fc region comprises one or more mutations described herein.

A fragment crystallizable region, or Fc region, refers to a region of an immunoglobulin that interacts with an Fc receptor. In an embodiment, the Fc region interacts with a protein of the complement system. While without wishing to be bound by theory, it is believed that in an embodiment, the interaction between the Fc region with an Fc receptor, allows for activation of the immune system.

In IgG, IgA and IgD antibody isotypes, the naturally-occurring Fc region generally comprises two identical protein fragments, derived from the second and third constant domains of the antibody's two heavy chains. Naturally-occurring IgM and IgE Fc regions generally comprise three heavy chain constant domains ($C_H$ domains 2-4) in each polypeptide chain. The Fc regions of IgGs can contain a highly conserved N-glycosylation site (Stadlmann et al. (2008). *Proteomics* 8 (14): 2858-2871; Stadlmann (2009) *Proteomics* 9 (17): 4143-4153). While not wishing to be bound by theory, it is believed that in an embodiment, glycosylation of the Fc fragment contributes to Fc receptor-mediated activities (Peipp et al. (2008) *Blood* 112 (6): 2390-2399). In an embodiment, the N-glycans attached to this site are predominantly core-fucosylated diantennary structures of the complex type. In another embodiment, small amounts of these N-glycans also contain bisecting GlcNAc and/or α-2,6 linked sialic acid residues.

An exemplary fragment of an Fc region amino acid sequence from human IgG1 is provided in SEQ ID NO: 40 and is shown below:

```
                                      (SEQ ID NO: 40)
DKTHTCPPCPAPELLGGPSVFLFPPKPKDTLMISRTPEVTCV

VVDVSHEDPEVKFNWYVDGVEVHNAKTKPREEQYGSTYRVVS

VLTVLHQDWLNGKEYKCKVSNKALPAPIEKTISKAKGQPREP

QVYTLPPSRDELTKNQVSLTCLVKGFYPSDIAVEWESNGQPE

NNYKTTPPVLDSDGSFFLYSKLTVDKSRWQQGNVFSCSVMHE

ALHNHYTQKSLSLSPGK
```

In SEQ ID NO: 40, the first amino acid residue in this sequence is referred to as position 221 herein. The three histidine residues shown in bold and underlined are positions 310, 433 and 435, respectively.

An IL-2 agent comprising an Fc region or fragment thereof (e.g., IL-2-Fc fusion protein) described herein can have one or more (e.g., 2, 3, 4, 5, 6, 7, 8, 9, 10, 11, 12, 13, 14, 15, 16, 17, 18, 19, 20, 21, 22, 23, 24, 25, or more) of mutations or combinations of mutations described in Table 1 (e.g., according to EU numbering).

TABLE 1

| Exemplary Fc mutations | |
| --- | --- |
| Name | Mutation |
| FcMut001 | I253M |
| FcMut002 | L309H_D312A_N315D |
| FcMut003 | L309N |
| FcMut004 | M252E_S254R |
| FcMut005 | M252E_S254R_R255Y |
| FcMut006 | S254H |
| FcMut007 | S254M |
| FcMut008 | T256D_T307R |
| FcMut009 | T256L_N286I_T307I |
| FcMut010 | T256I_N286I_T307I |
| FcMut011 | K248S_D376Q |
| FcMut012 | K248S_D376N |
| FcMut013 | D376Q_E380A |
| FcMut014 | D376N_E380A |
| FcMut015 | D376Q_M428L |
| FcMut016 | K248S_A378I |
| FcMut017 | L314K |
| FcMut018 | T250Q_M428L |
| FcMut019 | M428L_N434A |
| FcMut020 | N434A |
| FcMut021 | T307A_E380A_N434A |
| FcMut022 | M252W |
| FcMut023 | V308F |
| FcMut024 | V308F_N434Y |
| FcMut026 | T256D_T307R_D376N |
| FcMut027 | L309R_D312E |
| FcMut028 | L309R_Q311P_D312E |
| FcMut029 | K246N_P247A |
| FcMut030 | K246N_P247A_D376N |
| FcMut031 | T256E_T307R |
| FcMut032 | T256R_T307D |
| FcMut033 | T256R_T307E |
| FcMut034 | Q311P |
| FcMut035 | D376Q |
| FcMut036 | L234A_L235A |
| FcMut037 | L235V_G236A |
| FcMut038 | L234P_L235P |
| FcMut039 | L235P |
| FcMut040 | P329G |
| FcMut041 | P329E |
| FcMut042 | E233K |
| FcMut043 | T256D_N286D_A287S_T307R |
| FcMut044 | T256D_P257L_T307R |
| FcMut045 | T256D_T307R_Q311V |
| FcMut046 | P247D_T256D_T307R |
| FcMut047 | P247D_N286D_A287S_Q311V |
| FcMut048 | P257M_V308N |
| FcMut049 | V279I_Q311L_N315T |
| FcMut050 | M428L_N434S |
| FcMut051 | N434S |
| FcMut052 | H433G_N434P |
| FcMut053 | V259I_V308F_M428L |
| FcMut067 | T256D_N286D_T307R |
| FcMut068 | T256D_N286E_T307R |
| FcMut069 | T256D_N286Q_T307R |
| FcMut070 | T256D_P257T_T307R |
| FcMut071 | T256D_P257V_T307R |
| FcMut072 | T256D_T307R_Q311I |
| FcMut073 | T256D_T307R_Q311L |
| FcMut074 | T256D_T307R_Q311M |
| FcMut075 | T256D_P257L_N286D_T307R_Q311V |
| FcMut076 | T256D_T307R_M428L |
| FcMut077 | M428L |
| FcMut078 | M252Y_S254T_T256Q |
| FcMut079 | M252Y_S254T_T256E_K288E |
| FcMut080 | T256K_K288E |
| FcMut081 | T256D_E258T |
| FcMut082 | E283Q_H285E |
| FcMut083 | R344D_D401R |
| FcMut084 | K248E_E380K |
| FcMut085 | K248E_E380R |
| FcMut086 | K246H |
| FcMut087 | K248H |
| FcMut088 | T250I |
| FcMut089 | T250V |
| FcMut090 | L251F |

TABLE 1-continued

| Exemplary Fc mutations | |
| --- | --- |
| Name | Mutation |
| FcMut091 | L251M |
| FcMut093 | P257V |
| FcMut094 | N276D |
| FcMut095 | H285N |
| FcMut096 | H285D |
| FcMut097 | K288H |
| FcMut098 | K288Q |
| FcMut099 | K288E |
| FcMut100 | T307E |
| FcMut101 | T307Q |
| FcMut102 | V308P |
| FcMut103 | V308I |
| FcMut104 | V308L |
| FcMut105 | L309H |
| FcMut106 | L309M |
| FcMut107 | Q311H |
| FcMut108 | L314F |
| FcMut109 | Y319H |
| FcMut110 | I336T |
| FcMut111 | P343D |
| FcMut112 | P343V |
| FcMut113 | E345Q |
| FcMut114 | P346V |
| FcMut115 | P374T |
| FcMut116 | D376N |
| FcMut117 | A378S |
| FcMut118 | A431T |
| FcMut119 | A431P |
| FcMut120 | A431G |
| FcMut121 | L432V |
| FcMut122 | L432I |
| FcMut123 | L432Q |
| FcMut124 | N434T |
| FcMut125 | H435N |
| FcMut126 | Y436H |
| FcMut127 | K439Q |
| FcMut128 | T256D |
| FcMut129 | T307R |
| FcMut130 | A378T |
| FcMut131 | A378D |
| FcMut132 | A378H |
| FcMut133 | A378Y |
| FcMut134 | A378V |
| FcMut135 | D376R |
| FcMut136 | D376F |
| FcMut137 | D376W |
| FcMut138 | L314H |
| FcMut139 | L432E_T437Q |
| FcMut140 | D376Q_A378T |
| FcMut141 | D376Q_I377M_A378T |
| FcMut142 | P244Q_D376Q |
| FcMut143 | P247T_A378T |
| FcMut144 | P247N_A378T |
| FcMut145 | T256D_T307R_L309T |
| FcMut146 | A339T_S375E_F404Y |
| FcMut147 | L235V_G236A_T256D_T307R |
| FcMut148 | L235V_G236A_D376Q_M428L |
| FcMut149 | L314N |
| FcMut150 | N315D |
| FcMut151 | A378T |
| FcMut152 | T437Q |
| FcMut153 | L432E |
| FcMut154 | Y436H |
| FcMut155 | L314M |
| FcMut156 | L234A_L235A_T256D_T307R_Q311V |
| FcMut157 | L234A_L235A_T256D_P257V_T307R |
| FcMut158 | L234A_L235A_T256D_P257L_N286D_T307R_Q311V |
| FcMut159 | L235V_G236A_T256D_T307R_Q311V |
| FcMut160 | L235V_G236A_T256D_P257V_T307R |
| FcMut161 | L235V_G236A_T256D_P257L_N286D_T307R_Q311V |
| FcMut162 | S267T_A327N_A330M |
| FcMut163 | S267T_A327N |
| FcMut164 | L235V_G236A_S267T_A327N_A330M |
| FcMut165 | L235V_G236A_S267T_A327N |
| FcMut166 | M252Y_S254T |
| FcMut167 | T256E |

TABLE 1-continued

Exemplary Fc mutations

| Name | Mutation |
|------|----------|
| FcMut168 | G236A__I332E |
| FcMut169 | S239D__I332E |
| FcMut170 | G236A__S239D__I332E |
| FcMut171 | T256D__N286D__T307R__Q311V |
| FcMut172 | T256D__E258T__T307R |
| FcMut173 | T256D__E258T__T307R__Q311V |
| FcMut174 | T256D__P257V__E258T__T307R |
| FcMut175 | T256D__P257L__E258T__N286D__T307R__Q311V |
| FcMut176 | T256D__E258T__N286D__T307R__Q311V |
| FcMut177 | A378V__M428L |
| FcMut178 | A378V__M428I |
| FcMut179 | A378V__M428V |
| FcMut180 | T256D__N286D |
| FcMut181 | T256D__A378V |
| FcMut182 | T256D__Q311V |
| FcMut183 | T256D__Q311V__A378V |
| FcMut184 | T256D__T307R__A378V |
| FcMut185 | T256D__N286D__T307R__A378V |
| FcMut186 | T256D__T307R__Q311V__A378V |
| FcMut187 | H285D__A378V |
| FcMut188 | H285D__Q311V |
| FcMut189 | T256D__H285D |
| FcMut190 | T256D__H285D__Q311V |
| FcMut191 | T256D__H285D__T307R |
| FcMut192 | T256D__H285D__T307R__A378V |
| FcMut193 | H285D__L314M__A378V |
| FcMut194 | T256D__E258T__H285D__Q311H |
| FcMut195 | T256D__E258T__H285D |
| FcMut196 | H285D__N315D |
| FcMut197 | H285N__T307Q__N315D |
| FcMut198 | H285D__L432E__T437Q |
| FcMut199 | T256D__E258T__N315D |
| FcMut200 | P257V__H285N |
| FcMut201 | H285N__L432F |
| FcMut202 | H285N__T437I |
| FcMut203 | T256D__E258T__L314M |
| FcMut204 | T256D__E258T__T307Q |
| FcMut205 | T256D__E258T__A378V |
| FcMut206 | V308P__A378V |
| FcMut207 | P257V__A378T |
| FcMut208 | P257V__V308P__A378V |
| FcMut209 | N315D__A378T |
| FcMut210 | H285N__L314M |
| FcMut211 | L314M__L432E__T437Q |
| FcMut212 | T307Q__N315D |
| FcMut213 | H285D__T307Q__A378V |
| FcMut214 | L314M__N315D |
| FcMut215 | T307Q__Q311V__A378V |
| FcMut216 | H285D__Q311V__A378V |
| FcMut217 | Q311V__N315D__A378V |
| FcMut218 | T256D__E258T__Q311V |
| FcMut219 | T256D__N315D__A378V |
| FcMut220 | T256D__Q311V__N315D |
| FcMut221 | T256D__T307Q__A378V |
| FcMut222 | T256D__T307Q__Q311V |
| FcMut223 | T256D__H285D__A378V |
| FcMut224 | T256D__H285D__T307R__Q311V |
| FcMut225 | T256D__H285D__N286D__T307R |
| FcMut226 | T256D__H285D__N286D__T307R__Q311V |
| FcMut227 | T256D__H285D__N286D__T307R__A378V |
| FcMut228 | T256D__N286D__T307R__Q311V__A378V |
| FcMut229 | T256D__H285D__T307R__Q311V__A378V |
| FcMut230 | V308P__Q311V__A378V |
| FcMut231 | T256D__V308P__A378V |
| FcMut232 | T256D__V308P__Q311V |
| FcMut233 | T256D__E258T__V308P |
| FcMut234 | H285D__V308P__Q311V |
| FcMut242 | E258T |
| FcMut243 | N286D |
| FcMut244 | Q311V |
| YTE | M252Y__S254T__T256E |

In an embodiment, the Fc region comprises FcMut001. In an embodiment, the Fc region comprises FcMut002. In an embodiment, the Fc region comprises FcMut003. In an embodiment, the Fc region comprises FcMut004. In an embodiment, the Fc region comprises FcMut005. In an embodiment, the Fc region comprises FcMut006. In an embodiment, the Fc region comprises FcMut007. In an embodiment, the Fc region comprises FcMut008. In an embodiment, the Fc region comprises FcMut009. In an embodiment, the Fc region comprises FcMut010. In an embodiment, the Fc region comprises FcMut011. In an embodiment, the Fc region comprises FcMut012. In an embodiment, the Fc region comprises FcMut013. In an embodiment, the Fc region comprises FcMut014. In an embodiment, the Fc region comprises FcMut015. In an embodiment, the Fc region comprises FcMut016. In an embodiment, the Fc region comprises FcMut017. In an embodiment, the Fc region comprises FcMut018. In an embodiment, the Fc region comprises FcMut019. In an embodiment, the Fc region comprises FcMut020. In an embodiment, the Fc region comprises FcMut021. In an embodiment, the Fc region comprises FcMut022. In an embodiment, the Fc region comprises FcMut023. In an embodiment, the Fc region comprises FcMut024. In an embodiment, the Fc region comprises FcMut026. In an embodiment, the Fc region comprises FcMut027. In an embodiment, the Fc region comprises FcMut028. In an embodiment, the Fc region comprises FcMut029. In an embodiment, the Fc region comprises FcMut030. In an embodiment, the Fc region comprises FcMut031. In an embodiment, the Fc region comprises FcMut032. In an embodiment, the Fc region comprises FcMut033. In an embodiment, the Fc region comprises FcMut034. In an embodiment, the Fc region comprises FcMut035. In an embodiment, the Fc region comprises FcMut036. In an embodiment, the Fc region comprises FcMut037. In an embodiment, the Fc region comprises FcMut038. In an embodiment, the Fc region comprises FcMut039. In an embodiment, the Fc region comprises FcMut040. In an embodiment, the Fc region comprises FcMut041. In an embodiment, the Fc region comprises FcMut042. In an embodiment, the Fc region comprises FcMut043. In an embodiment, the Fc region comprises FcMut044. In an embodiment, the Fc region comprises FcMut045. In an embodiment, the Fc region comprises FcMut046. In an embodiment, the Fc region comprises FcMut047. In an embodiment, the Fc region comprises FcMut048. In an embodiment, the Fc region comprises FcMut049. In an embodiment, the Fc region comprises FcMut050. In an embodiment, the Fc region comprises FcMut051. In an embodiment, the Fc region comprises FcMut052. In an embodiment, the Fc region comprises FcMut053. In an embodiment, the Fc region comprises FcMut067. In an embodiment, the Fc region comprises FcMut068. In an embodiment, the Fc region comprises FcMut069. In an embodiment, the Fc region comprises FcMut070. In an embodiment, the Fc region comprises FcMut071. In an embodiment, the Fc region comprises FcMut072. In an embodiment, the Fc region comprises FcMut073. In an embodiment, the Fc region comprises FcMut074. In an embodiment, the Fc region comprises FcMut075. In an embodiment, the Fc region comprises FcMut076. In an embodiment, the Fc region comprises FcMut077. In an embodiment, the Fc region comprises FcMut078. In an embodiment, the Fc region comprises FcMut079. In an embodiment, the Fc region comprises FcMut080. In an embodiment, the Fc region comprises FcMut081. In an embodiment, the Fc region comprises FcMut082. In an embodiment, the Fc region comprises FcMut083. In an embodiment, the Fc region comprises FcMut084. In an embodiment, the Fc region comprises FcMut085. In an
embodiment, the Fc region comprises FcMut086. In an
embodiment, the Fc region comprises FcMut087. In an
embodiment, the Fc region comprises FcMut088. In an
embodiment, the Fc region comprises FcMut089. In an
embodiment, the Fc region comprises FcMut090. In an
embodiment, the Fc region comprises FcMut091. In an
embodiment, the Fc region comprises FcMut093. In an
embodiment, the Fc region comprises FcMut094. In an
embodiment, the Fc region comprises FcMut095. In an
embodiment, the Fc region comprises FcMut096. In an
embodiment, the Fc region comprises FcMut097. In an
embodiment, the Fc region comprises FcMut098. In an
embodiment, the Fc region comprises FcMut099. In an
embodiment, the Fc region comprises FcMut100. In an
embodiment, the Fc region comprises FcMut101. In an
embodiment, the Fc region comprises FcMut102. In an
embodiment, the Fc region comprises FcMut103. In an
embodiment, the Fc region comprises FcMut104. In an
embodiment, the Fc region comprises FcMut105. In an
embodiment, the Fc region comprises FcMut106. In an
embodiment, the Fc region comprises FcMut107. In an
embodiment, the Fc region comprises FcMut108. In an
embodiment, the Fc region comprises FcMut109. In an
embodiment, the Fc region comprises FcMut110. In an
embodiment, the Fc region comprises FcMut111. In an
embodiment, the Fc region comprises FcMut112. In an
embodiment, the Fc region comprises FcMut113. In an
embodiment, the Fc region comprises FcMut114. In an
embodiment, the Fc region comprises FcMut115. In an
embodiment, the Fc region comprises FcMut116. In an
embodiment, the Fc region comprises FcMut117. In an
embodiment, the Fc region comprises FcMut118. In an
embodiment, the Fc region comprises FcMut119. In an
embodiment, the Fc region comprises FcMut120. In an
embodiment, the Fc region comprises FcMut121. In an
embodiment, the Fc region comprises FcMut122. In an
embodiment, the Fc region comprises FcMut123. In an
embodiment, the Fc region comprises FcMut124. In an
embodiment, the Fc region comprises FcMut125. In an
embodiment, the Fc region comprises FcMut126. In an
embodiment, the Fc region comprises FcMut127. In an
embodiment, the Fc region comprises FcMut128. In an
embodiment, the Fc region comprises FcMut129. In an
embodiment, the Fc region comprises FcMut130. In an
embodiment, the Fc region comprises FcMut131. In an
embodiment, the Fc region comprises FcMut132. In an
embodiment, the Fc region comprises FcMut133. In an
embodiment, the Fc region comprises FcMut134. In an
embodiment, the Fc region comprises FcMut135. In an
embodiment, the Fc region comprises FcMut136. In an
embodiment, the Fc region comprises FcMut137. In an
embodiment, the Fc region comprises FcMut138. In an
embodiment, the Fc region comprises FcMut139. In an
embodiment, the Fc region comprises FcMut140. In an
embodiment, the Fc region comprises FcMut141. In an
embodiment, the Fc region comprises FcMut142. In an
embodiment, the Fc region comprises FcMut143. In an
embodiment, the Fc region comprises FcMut144. In an
embodiment, the Fc region comprises FcMut145. In an
embodiment, the Fc region comprises FcMut146. In an
embodiment, the Fc region comprises FcMut147. In an
embodiment, the Fc region comprises FcMut148. In an
embodiment, the Fc region comprises FcMut149. In an
embodiment, the Fc region comprises FcMut150. In an
embodiment, the Fc region comprises FcMut151. In an
embodiment, the Fc region comprises FcMut152. In an embodiment, the Fc region comprises FcMut153. In an
embodiment, the Fc region comprises FcMut154. In an
embodiment, the Fc region comprises FcMut155. In an
embodiment, the Fc region comprises FcMut156. In an
embodiment, the Fc region comprises FcMut157. In an
embodiment, the Fc region comprises FcMut158. In an
embodiment, the Fc region comprises FcMut159. In an
embodiment, the Fc region comprises FcMut160. In an
embodiment, the Fc region comprises FcMut161. In an
embodiment, the Fc region comprises FcMut162. In an
embodiment, the Fc region comprises FcMut163. In an
embodiment, the Fc region comprises FcMut164. In an
embodiment, the Fc region comprises FcMut165. In an
embodiment, the Fc region comprises FcMut166. In an
embodiment, the Fc region comprises FcMut167. In an
embodiment, the Fc region comprises FcMut168. In an
embodiment, the Fc region comprises FcMut169. In an
embodiment, the Fc region comprises FcMut170. In an
embodiment, the Fc region comprises FcMut171. In an
embodiment, the Fc region comprises FcMut172. In an
embodiment, the Fc region comprises FcMut173. In an
embodiment, the Fc region comprises FcMut174. In an
embodiment, the Fc region comprises FcMut175. In an
embodiment, the Fc region comprises FcMut176. In an
embodiment, the Fc region comprises FcMut177. In an
embodiment, the Fc region comprises FcMut178. In an
embodiment, the Fc region comprises FcMut179. In an
embodiment, the Fc region comprises FcMut180. In an
embodiment, the Fc region comprises FcMut181. In an
embodiment, the Fc region comprises FcMut182. In an
embodiment, the Fc region comprises FcMut183. In an
embodiment, the Fc region comprises FcMut184. In an
embodiment, the Fc region comprises FcMut185. In an
embodiment, the Fc region comprises FcMut186. In an
embodiment, the Fc region comprises FcMut187. In an
embodiment, the Fc region comprises FcMut188. In an
embodiment, the Fc region comprises FcMut189. In an
embodiment, the Fc region comprises FcMut190. In an
embodiment, the Fc region comprises FcMut191. In an
embodiment, the Fc region comprises FcMut192. In an
embodiment, the Fc region comprises FcMut193. In an
embodiment, the Fc region comprises FcMut194. In an
embodiment, the Fc region comprises FcMut195. In an
embodiment, the Fc region comprises FcMut196. In an
embodiment, the Fc region comprises FcMut197. In an
embodiment, the Fc region comprises FcMut198. In an
embodiment, the Fc region comprises FcMut199. In an
embodiment, the Fc region comprises FcMut200. In an
embodiment, the Fc region comprises FcMut201. In an
embodiment, the Fc region comprises FcMut202. In an
embodiment, the Fc region comprises FcMut203. In an
embodiment, the Fc region comprises FcMut204. In an
embodiment, the Fc region comprises FcMut205. In an
embodiment, the Fc region comprises FcMut206. In an
embodiment, the Fc region comprises FcMut207. In an
embodiment, the Fc region comprises FcMut208. In an
embodiment, the Fc region comprises FcMut209. In an
embodiment, the Fc region comprises FcMut210. In an
embodiment, the Fc region comprises FcMut211. In an
embodiment, the Fc region comprises FcMut212. In an
embodiment, the Fc region comprises FcMut213. In an
embodiment, the Fc region comprises FcMut214. In an
embodiment, the Fc region comprises FcMut215. In an
embodiment, the Fc region comprises FcMut216. In an
embodiment, the Fc region comprises FcMut217. In an
embodiment, the Fc region comprises FcMut218. In an
embodiment, the Fc region comprises FcMut219. In an embodiment, the Fc region comprises FcMut220. In an embodiment, the Fc region comprises FcMut221. In an embodiment, the Fc region comprises FcMut222. In an embodiment, the Fc region comprises FcMut223. In an embodiment, the Fc region comprises FcMut224. In an embodiment, the Fc region comprises FcMut225. In an embodiment, the Fc region comprises FcMut226. In an embodiment, the Fc region comprises FcMut227. In an embodiment, the Fc region comprises FcMut228. In an embodiment, the Fc region comprises FcMut229. In an embodiment, the Fc region comprises FcMut230. In an embodiment, the Fc region comprises FcMut231. In an embodiment, the Fc region comprises FcMut232. In an embodiment, the Fc region comprises FcMut233. In an embodiment, the Fc region comprises FcMut234. In an embodiment, the Fc region comprises FcMut242. In an embodiment, the Fc region comprises FcMut243. In an embodiment, the Fc region comprises FcMut244.

In an embodiment, the Fc region comprises one or more (e.g., 2, 3, 4, 5, 6, 7, 8, 9, or more) of mutations or combinations of mutations chosen from FcMut045, FcMut171, FcMut183, FcMut186, FcMut190, FcMut197, FcMut213, FcMut215, FcMut216, FcMut219, FcMut222, FcMut223, FcMut224, FcMut226, FcMut227, FcMut228, or FcMut229. In an embodiment, the Fc region comprises one or more (e.g., 2, 3, 4, 5, 6, or all) of mutations or combinations of mutations chosen from FcMut045, FcMut183, FcMut197, FcMut213, FcMut215, FcMut228, or FcMut156. In another embodiment, the Fc region comprises one or more (e.g., 2, 3, 4, 5, or all) of mutations or combinations of mutations chosen from FcMut183, FcMut197, FcMut213, FcMut215, FcMut228, or FcMut229.

In an embodiment, the Fc region does not comprise one or more (e.g., 2, 3, 4, or all) of mutations or combinations of mutations chosen from FcMut018, FcMut021, FcMut050, FcMut102, or YTE. In an embodiment, the Fc region comprises one or more (e.g., 2, 3, 4, or all) of mutations or combinations of mutations chosen from FcMut018, FcMut021, FcMut050, FcMut102, or YTE, and one or more other mutations or combinations of mutations described in Table 1.

In an embodiment, the Fc region comprises one or more (e.g., 2, 3, 4, 5, 6, 7, 8, 9, 10, 11, 12, 13, 14, 15, 16, 17, 18, 19, 20, or more) of mutations or combinations of mutations described in Table 1 that result in a synergistic effect (e.g., binding affinity or circulating half-life) as described herein.

In an embodiment, the Fc region comprises one or more (e.g., 2, 3, 4, 5, 6, or 7) mutations in residues chosen from T256, H285, N286, T307, Q311, N315, or A378. In an embodiment, the Fc region comprises one or more (e.g., 2, 3, 4, 5, 6, or 7) mutations chosen from T256D, H285N, N286D, T307Q, Q311V, N315D, or A378V.

In an embodiment, the Fc region comprises a half-life enhancing mutation, a mutation that is capable of disrupting an Fc effector function, or both. In an embodiment, the Fc region comprises one or more mutations or combinations of mutations described herein, e.g., chosen from M252W, V308F/N434Y, R255Y, P257L/N434Y, V308F, P257N/M252Y, G385N, P257N/V308Y, N434Y, M252Y/S254T/T256E ("YTE"), M428L/N434S ("LS"), or any combination thereof. Alternatively, or additionally, in an embodiment, the Fc region comprises (a) one or more (e.g., 2, 3, 4, 5, or all) combinations of mutations chosen from: T256D/Q311V/A378V, H285N/T307Q/N315D, H285D/T307Q/A378V, T307Q/Q311V/A378V, T256D/N286D/T307R/Q311V/A378V, or T256D/T307R/Q311V; (b) a mutation or a combination of mutations capable of disrupting an Fc effector function, e.g., N297G, L234A/L235A (also known as "LALA" mutation), L234A/L235A/P329G (also known as "LALAPG" mutation), or (c) both (a) and (b).

In an embodiment, the Fc region comprises mutations T256D/Q311V/A378V and a mutation or a combination of mutations capable of disrupting an Fc effector function, e.g., L234A/L235A. In an embodiment, the Fc region comprises mutations H285N/T307Q/N315D and a mutation or a combination of mutations capable of disrupting an Fc effector function, e.g., L234A/L235A. In an embodiment, the Fc region comprises mutations H285D/T307Q/A378V and a mutation or a combination of mutations capable of disrupting an Fc effector function, e.g., L234A/L235A. In an embodiment, the Fc region comprises mutations T307Q/Q311V/A378V and a mutation or a combination of mutations capable of disrupting an Fc effector function, e.g., L234A/L235A. In an embodiment, the Fc region comprises mutations T256D/N286D/T307R/Q311V/A378V and a mutation or a combination of mutations capable of disrupting an Fc effector function, e.g., L234A/L235A. In an embodiment, the Fc region comprises mutations T256D/T307R/Q311V and a mutation or a combination of mutations capable of disrupting an Fc effector function, e.g., L234A/L235A. Other exemplary Fc mutations are described, e.g., in International Application Publication No. WO2018/052556, U.S. Application Publication No. US2018/0037634, and Booth et al. MAbs. 2018; 10 (7): 1098-1110, the contents of which are incorporated by reference in their entirety.

In an embodiment the Fc region comprises the Fc region of human IgG1, e.g., human IgG1 m3 allotype. In an embodiment, the Fc region comprises the mutation N297G. In an embodiment, the Fc region comprises the Fc region of human IgG1 allotype m3, human IgG1 allotype m3 comprising the mutation N297G and/or other mutations of the Fc region of human IgG1 allotype m3, or a fragment thereof. In an embodiment, the Fc region comprises the sequence of SEQ ID NO: 1003, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

Any of the mutations in the Fc region that extend half-life described herein can be used in combination with any Fc mutation capable of enhancing or disrupting an Fc effector function.

In an embodiment the Fc region comprises the Fc region of human IgG4, human IgG4 containing S228P mutation, and/or R409K mutation, and/or other mutations of the Fc region of human IgG4, or a fragment thereof. An exemplary fragment of an Fc region amino acid sequence from human IgG4 is provided in SEQ ID NO: 44 and is shown below:

(SEQ ID NO: 44)

$E_{219}$SKYGPPCPP$_{228}$CPAPEFLGGPSV$_{240}$FLFPPKPKDT$_{250}$LMISR

TPEVT$_{260}$CVVVDVSQED$_{270}$PEVQFNWYVD$_{280}$GVEVHNAKTK$_{290}$PR

EEQFNSTY$_{300}$RVVSVLT$_{307}$VLHQ$_{311}$DWLNGKEYK$_{320}$CKVSNKGLP

S$_{330}$SIEKTISKAK$_{340}$GQPREPQVYT$_{350}$LPPSQEEMTK$_{360}$NQVSLT

CLVK$_{370}$GFYPSDIA$_{378}$VEWESNGQPENNYKTTPPVLDSDGSFFLY

SRLTVDKSRWQEGNVFSCSVMHEALHNHYTQKSLSLSLGK

In SEQ ID NO: 44, the first amino acid residue in this sequence is referred to as position 219 herein. Mutations described to extend the half-life of human IgG1 can be applied to human IgG4 Fc. For example, Mut215 corresponds to mutations T307Q/Q311V/A378V in SEQ ID NO: 44.

The Fc region can bind to various cell receptors (e.g., Fc receptors) and complement proteins. The Fc region can also mediate different physiological effects of antibody molecules, e.g., detection of opsonized particles; cell lysis; degranulation of mast cells, basophils, and eosinophils; and other processes.

There are several different types of Fc receptors (FcR), which can be classified based on the type of antibody that they recognize.

Fcγ receptors (FcγR) belong to the immunoglobulin superfamily, and are involved, e.g., in inducing phagocytosis of opsonized microbes. This family includes several members, FcγRI (CD64), FcγRIIA (CD32), FcγRIIB (CD32), FcγRIIIA (CD16a), FcγRIIIB (CD16b), which differ in their antibody affinities due to their different molecular structure. For instance, FcγRI can bind to IgG more strongly than FcγRII or FcγRIII does. FcγRI also has an extracellular portion comprising three immunoglobulin (Ig)-like domains, one more domain than FcγRII or FcγRIII has. This property allows FcγRI to bind a sole IgG molecule (or monomer), but Fcγ receptors generally need to bind multiple IgG molecules within an immune complex to be activated.

The Fcγ receptors differ in their affinity for IgG and the different IgG subclasses can have unique affinities for each of the Fcγ receptors. These interactions can be further tuned by the glycan (oligosaccharide) at certain position of IgG. For example, by creating steric hindrance, fucose containing CH2-84.4 glycans reduce IgG affinity for FcγRIIIA, whereas G0 glycans, which lack galactose and terminate instead with GlcNAc moieties, have increased affinity for FcγRIIIA (Maverakis et al. (2015) *Journal of Autoimmunity* 57 (6): 1-13).

The neonatal Fc receptor (FcRn) is expressed on multiple cell types and is similar in structure to MHC class I. This receptor also binds IgG and is involved in preservation of this antibody (Zhu et al. (2001). *Journal of Immunology* 166 (5): 3266-76). FcRn is also involved in transferring IgG from a mother either via the placenta to her fetus or in milk to her suckling infant. This receptor may also play a role in the homeostasis of IgG serum levels.

FcαRI (or CD89) belongs to the FcαR subgroup. FcαRI is found on the surface of neutrophils, eosinophils, monocytes, macrophages (including Kupffer cells), and dendritic cells. It comprises two extracellular Ig-like domains and is a member of both the immunoglobulin superfamily and the multi-chain immune recognition receptor (MIRR) family. It signals by associating with two FcRγ signaling chains.

Fc-alpha/mu receptor (Fcα/μR) is a type I transmembrane protein. It can bind IgA, although it has higher affinity for IgM (Shibuya and Honda (2006) *Springer Seminars in Immunopathology* 28 (4): 377-82). With one Ig-like domain in its extracellular portion, this Fc receptor is also a member of the immunoglobulin superfamily.

There are two known types of FcεR. The high-affinity receptor FcεRI is a member of the immunoglobulin superfamily (it has two Ig-like domains). FcεRI is found on epidermal Langerhans cells, eosinophils, mast cells and basophils. This receptor can play a role in controlling allergic responses. FcεRI is also expressed on antigen-presenting cells, and controls the production of immune mediators, e.g., cytokines that promote inflammation (von Bubnoff et al. (2003) *Clinical and Experimental Dermatology* 28 (2): 184-7). The low-affinity receptor FcεRII (CD23)

is a C-type lectin. FcεRII has multiple functions as a membrane-bound or soluble receptor. It can also control B cell growth and differentiation and blocks IgE-binding of eosinophils, monocytes, and basophils (Kikutani et al. (1989) *Ciba Foundation Symposium* 147:23-31).

In an embodiment, the Fc region can be engineered to contain an antigen-binding site to generate an Fcab fragment (Wozniak-Knopp et al. (2010) *Protein Eng Des* 23 (4): 289-297). Fcab fragments can be inserted into a full immunoglobulin by swapping the Fc region, thus obtaining a bispecific antibody (with both Fab and Fcab regions containing distinct binding sites).

The binding and recycling of FcRn can be illustrated below. For example, IgG and albumin are internalized into vascular endothelial cells through pinocytosis. The pH of the endosome is 6.0, facilitating association with membrane-bound FcRn. The contents of endosomes can be processed in one of two ways: either recycling back to the apical cell membrane or transcytosis from the apical to the basolateral side. IgG not associated with FcRn is degraded by lysosomes.

Figure 1B:
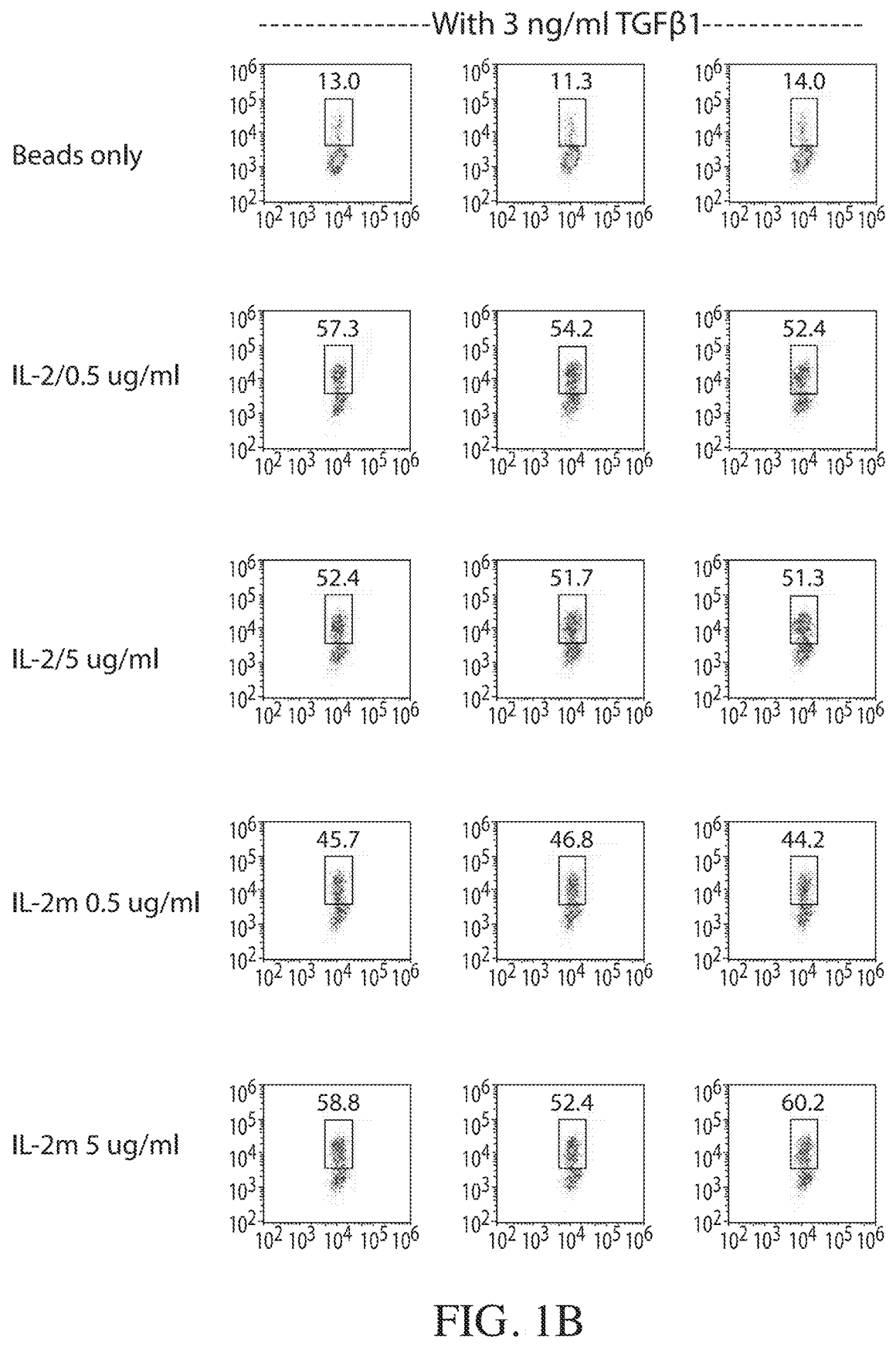

While not wishing to be bound by theory, it is believed that FcRn interaction with IgG is mediated through Fc. The binding of Fc to FcRn is pH specific, e.g., no significant binding at pH 7.4 and strong binding in acidic environment. Structure of FcRn in complex with Fc domain of IgG1 molecule is described, e.g., in FIG. 1 of International Application Publication No. WO2018/052556 or U.S. Application Publication No. US2018/0037634. Each FcRn molecule generally binds to an Fc-monomer. In an embodiment, Fab domains can also influence binding of IgG to FcRn, e.g., have either a negative or no influence on the affinity of the IgG for FcRn.

There can be multiple considerations when an Fc region is engineered to enhance half-life of a polypeptide. For example, prolonging half-life and efficient recirculation of antibody molecules or fusion proteins often requires pH specific affinity enhancement (e.g., only at low pH of the endosome). FcRn binds proximal to the linker region between CH2 and CH3 domains of a Fc region. Modifications to the linker can impact Fc engagement with Fcγ receptors. Modifications on the Fc region can impact thermal stability and aggregation properties of the polypeptide.

Pharmaceutical Compositions and Kits

The present disclosure provides compositions, e.g., pharmaceutical compositions, which include an IL-2 agent described herein, and optionally a pharmaceutically acceptable carrier.

As used herein, "pharmaceutically acceptable carrier" includes any and all solvents, dispersion media, isotonic and absorption delaying agents, and the like that are physiologically compatible. The carrier can be suitable for intravenous, intramuscular, subcutaneous, parenteral, rectal, spinal or epidermal administration (e.g., by injection or infusion). In an embodiment, less than about 5%, e.g., less than about 4%, 3%, 2%, or 1% of the IL-2 agents in the composition are present as aggregates. In an embodiment, at least about 95%, e.g., at least about 96%, 97%, 98%, 98.5%, 99%, 99.5%, 99.8%, or more of the IL-2 agents in the composition are present as monomers. In an embodiment, at least about 95%, e.g., at least about 96%, 97%, 98%, 98.5%, 99%, 99.5%, 99.8%, or more of the IL-2 agents in the composition are present as dimers. In an embodiment, the level of aggregates, dimers, or monomers is determined by chromatography, e.g., high performance liquid chromatography size exclusion chromatography (HPLC-SEC). In an embodiment, the IL-2 agent is formulated together with the pharmaceutically acceptable carrier.

The compositions set out herein may be in a variety of forms. These include, for example, liquid, semi-solid and solid dosage forms, such as liquid solutions (e.g., injectable and infusible solutions), dispersions or suspensions, liposomes, and suppositories. A suitable form depends on the intended mode of administration and therapeutic application. Typical suitable compositions are in the form of injectable or infusible solutions. One suitable mode of administration is parenteral (e.g., intravenous, subcutaneous, intraperitoneal, intramuscular). In an embodiment, the IL-2 agent is administered by intravenous infusion or injection. In another embodiment, the IL-2 agent is administered by intramuscular or subcutaneous injection. In an embodiment, the IL-2 agent is administered subcutaneously (e.g., presented in an autoinjector or prefilled syringe).

The terms "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Pharmaceutical compositions (e.g., for therapeutic applications) typically should be sterile and stable under the conditions of manufacture and storage. The composition can be formulated as a solution, microemulsion, dispersion, liposome, or other ordered structure suitable to high antibody concentration. Sterile injectable solutions can be prepared by incorporating the active compound (i.e., antibody or antibody portion) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

The IL-2 agents described herein can be administered by a variety of methods. Several are known in the art, and for many therapeutic, prophylactic, or diagnostic applications, an appropriate route/mode of administration is intravenous injection or infusion. For example, the IL-2 agents can be administered by intravenous infusion at a rate of less than 10 mg/min; preferably less than or equal to 5 mg/min to reach a dose of about 1 to 100 mg/m², preferably about 5 to 50 mg/m², about 7 to 25 mg/m² and more preferably, about 10 mg/m². As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., *Sustained and Controlled Release Drug Delivery Systems*, J. R. Robinson, ed., Marcel Dekker, Inc., New York, 1978.

In an embodiment, the IL-2 agent is orally administered, for example, with an inert diluent or an assimilable edible carrier. The IL-2 agent (and other ingredients, if desired) may also be enclosed in a hard or soft shell gelatin capsule, compressed into tablets, or incorporated directly into the subject's diet. For oral therapeutic administration, the IL-2 agent may be incorporated with excipients and used in the form of ingestible tablets, buccal tablets, troches, capsules, elixirs, suspensions, syrups, wafers, and the like. To administer an IL-2 agent by other than parenteral administration, it may be necessary to coat the compound with, or co-administer the compound with, a material to prevent its inactivation. Therapeutic, prophylactic, or diagnostic compositions can also be administered with medical devices, and several are known in the art.

Dosage regimens are adjusted to provide the desired response (e.g., a therapeutic, prophylactic, or diagnostic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms is dictated by and directly dependent on (a) the unique characteristics of the molecule and the particular therapeutic, prophylactic, or diagnostic effect to be achieved, and (b) the limitations inherent in the art of compounding such a molecule for the treatment of sensitivity in individuals.

An exemplary, non-limiting range for a therapeutically, prophylactically, or diagnostically effective amount of an IL-2 agent is about 0.1-50 mg/kg, e.g., about 0.1-30 mg/kg, e.g., about 1-30, 1-15, 1-10, 1-5, 5-10, or 1-3 mg/kg, e.g., about 1, 2, 3, 4, 5, 6, 7, 8, 9, 10, 15, 20, 30, 40, or 50 mg/kg. The IL-2 agent can be administered by intravenous infusion at a rate of less than 10 mg/min, e.g., less than or equal to 5 mg/min to reach a dose of about 1 to 100 mg/m², e.g., about 5 to 50 mg/m², about 7 to 25 mg/m², e.g., about 10 mg/m². It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed compositions.

The pharmaceutical compositions herein may include a "therapeutically effective amount," "prophylactically effective amount," or "diagnostically effectively amount" of an IL-2 agent described herein.

A "therapeutically effective amount" refers to an amount effective, at dosages and for periods of time necessary, to achieve the desired therapeutic result. A therapeutically effective amount of the polypeptide (e.g., antibody molecule or fusion protein) may vary according to factors such as the disease state, age, sex, and weight of the individual, and the ability of the antibody or antibody portion to elicit a desired response in the individual. A therapeutically effective amount is also one in which any toxic or detrimental effect of the antibody molecule is outweighed by the therapeutically beneficial effects. A "therapeutically effective dosage" typically inhibits a measurable parameter by at least about 20%, e.g., by at least about 40%, by at least about 60%, or by at least about 80% relative to untreated subjects. The measurable parameter may vary, e.g., based on the disordered being treated. The ability of an IL-2 agent to inhibit a measurable parameter can be evaluated in an animal model system predictive of efficacy in treating or preventing a disorder described herein. Alternatively, this property of a composition can be evaluated by examining the ability of the IL-2 agent to modulate a biological function of a target molecule or cell, e.g., by an in vitro assay.

A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

A "diagnostically effective amount" refers to an amount effective, at dosages and for periods of time necessary, to achieve the desired diagnostic result. Typically, a diagnostically effective amount is one in which a disorder, e.g., a disorder described herein, can be diagnosed in vitro, ex vivo, or in vivo.

In an embodiment, the pharmaceutical composition is a good manufacturing practices (GMP)-grade pharmaceutical composition. In an embodiment, the pharmaceutical composition has greater than 99% purity, e.g., greater than 99.5%, 99.8%, or 99.9% purity. In an embodiment, greater than 50%, 60%, 70%, 80%, 90%, 95%, 98%, or 99% of the contaminants in the pharmaceutical composition are removed. In an embodiment, the pharmaceutical composition is in large scale, e.g., at least 20 g, 30 g, 40 g, 50 g, 100 g, 200 g, 300 g, 400 g, 500 g, 600 g, 700 g, 800 g, 900 g, 1000 g, or more.

The disclosure also provides kits that comprise IL-2 agents described herein. The kits can include one or more other elements including: instructions for use; other reagents, e.g., a label, a therapeutic agent, or an agent useful for chelating, or otherwise coupling, an antibody molecule coupled to a label or therapeutic agent, or a radioprotective composition; devices or other materials for preparing the IL-2 agent for administration; pharmaceutically acceptable carriers; and devices or other materials for administration to a subject.

Nucleic Acids

The present disclosure also provides nucleic acids comprising a nucleotide sequence that encodes an IL-2 agent described herein.

In an embodiment, the nucleic acid comprises a nucleotide sequence encoding an amino acid sequence of an IL-2 variant described herein, or a nucleotide sequence substantially identical thereto (e.g., a sequence at least about 85%, 90%, 95%, 99% or more identical thereto, and/or capable of hybridizing under the stringency conditions described herein). In an embodiment, the nucleic acid comprises a nucleotide sequence encoding an IL-2 variant comprising one or more of the mutations described herein.

In an embodiment, the nucleic acid further comprises a nucleotide sequence encoding an Fc region, e.g., an Fc region described herein, or having a nucleotide sequence substantially identical thereto (e.g., a sequence at least about 85%, 90%, 95%, 99% or more identical thereto, and/or capable of hybridizing under the stringency conditions described herein). In an embodiment, the Fc region comprises one or more mutations, e.g., one or more mutations described herein. In an embodiment, the nucleic acid comprises from 5' to 3' a nucleotide sequence encoding an IL-2 variant described herein and a nucleotide sequence encoding an Fc region described herein.

In another embodiment, the nucleic acid further comprises a nucleotide sequence encoding a linker, e.g., a linker described herein, or a nucleotide sequence substantially homologous thereto (e.g., a sequence at least about 85%, 90%, 95%, 99% or more identical thereto, and/or capable of hybridizing under the stringency conditions described herein). In an embodiment, the nucleic acid comprises from 5' to 3' a nucleotide sequence encoding an IL-2 variant described herein and a nucleotide sequence encoding a linker described herein. In an embodiment, the nucleic acid comprises from 5' to 3' a nucleotide sequence encoding a linker described herein, and a nucleotide sequence encoding an Fc region described herein.

In another embodiment, the nucleic acid comprises a nucleotide sequence encoding an IL-2 fusion protein, e.g., an IL-2 fusion protein described herein, or a nucleotide sequence substantially homologous thereto (e.g., a sequence at least about 85%, 90%, 95%, 99% or more identical thereto, and/or capable of hybridizing under the stringency conditions described herein). In an embodiment, the nucleic acid encoding the IL-2 fusion protein comprises from 5' to 3' a nucleotide sequence encoding an IL-2 variant described herein and a nucleotide sequence encoding an Fc region described herein. In an embodiment, the nucleic acid encoding the IL-2 fusion protein comprises from 5' to 3' a nucleotide sequence encoding an IL-2 variant described herein, a nucleotide sequence encoding a linker described herein, and a nucleotide sequence encoding an Fc region described herein.

In an embodiment, the nucleic acid comprises a portion of a nucleotide sequence described herein. The portion may encode, for example, one, two, or all of an IL-2 variant, a linker, or an Fc region.

In an embodiment, the nucleic acid comprises a nucleotide sequence encoding an amino acid sequence described in Table 9, or a functional fragment thereof. In an embodiment, the nucleic acid comprises a nucleotide sequence described in Table 10.

In an embodiment, the nucleic acid comprises a nucleotide sequence encoding the amino acid sequence of any of SEQ ID NOs: 2-38 or 1000-1002, or a functional fragment thereof. In an embodiment, the nucleic acid comprises a nucleotide sequence encoding the amino acid sequence of any of SEQ ID NOs: 56-359 or 1004-1009, or a functional fragment thereof.

In an embodiment, the nucleic acid comprises a nucleotide sequence of any of SEQ ID NOs: 361-398 or 1010-1012, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, or 50 nucleotides thereto. In an embodiment, the nucleic acid further comprises a nucleotide sequence of any of SEQ ID NOs: 399-407 or 1013, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 nucleotides thereto. In an embodiment, the nucleic acid further comprises a nucleotide sequence of any of SEQ ID NOs: 408-415.

In an embodiment, the nucleic acid comprises a nucleotide sequence of any of SEQ ID NOs: 416-481 or 1014-1019, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, or 100 nucleotides thereto. In an embodiment, the nucleic acid comprises a nucleotide sequence of any of SEQ ID NOs: 416-453 or 1014-1019. In an embodiment, the nucleic acid comprises a nucleotide sequence of any of SEQ ID NOs: 454-491. In an embodiment, the nucleic acid comprises a nucleotide sequence of any of SEQ ID NOs: 492-529. In an embodiment, the nucleic acid comprises a nucleotide sequence of any of SEQ ID NOs: 416-453. In an embodiment, the nucleic acid comprises a nucleotide sequence of any of SEQ ID NOs: 454-491. In an embodiment, the nucleic acid comprises a nucleotide sequence of any of SEQ ID NOs: 492-529. In an embodiment, the nucleic acid comprises a nucleotide sequence of any of SEQ ID NOs: 530-567. In an embodiment, the nucleic acid comprises a nucleotide sequence of any of SEQ ID NOs: 568-605. In an embodiment, the nucleic acid comprises a nucleotide sequence of any of SEQ ID NOs: 606-643. In an embodiment, the nucleic acid comprises a nucleotide sequence of any of SEQ ID NOs: 644-681.

In an embodiment, the nucleic acid comprises the nucleotide sequence of any of SEQ ID NOs: 364, 365, 371, or 1010-1012, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, or 50 nucleotides thereto. In an embodiment, the nucleic acid comprises the nucleotide sequence of SEQ ID NO: 364. In an embodiment, the nucleic acid comprises the nucleotide sequence of SEQ ID NO: 365. In an embodiment, the nucleic acid comprises the nucleotide sequence of SEQ ID NO: 371. In an embodiment, the nucleic acid comprises the nucleotide sequence of SEQ ID NO: 1010. In an embodiment, the nucleic acid comprises the nucleotide sequence of SEQ ID NO: 1011. In an embodiment, the nucleic acid comprises the nucleotide sequence of SEQ ID NO: 1012.

In an embodiment, the nucleic acid further comprises the nucleotide sequence of SEQ ID NO: 1013, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 nucleotides thereto. In an embodiment, the nucleic acid further comprises the nucleotide sequence of SEQ ID NO: 48.

In an embodiment, the nucleic acid comprises the nucleotide sequence of any of SEQ ID NOs: 1014-1017, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, or 50 nucleotides thereto. In an embodiment, the nucleic acid comprises the nucleotide sequence of SEQ ID NO: 1014. In an embodiment, the nucleic acid comprises the nucleotide sequence of SEQ ID NO: 1015. In an embodiment, the nucleic acid comprises the nucleotide sequence of SEQ ID NO: 1016. In an embodiment, the nucleic acid comprises the nucleotide sequence of SEQ ID NO: 1017. In an embodiment, the nucleic acid comprises the nucleotide sequence of SEQ ID NO: 1018. In an embodiment, the nucleic acid comprises the nucleotide sequence of SEQ ID NO: 1019.

In an embodiment, the nucleic acid comprises the nucleotide sequence of SEQ ID NO: 364. In an embodiment, the nucleic acid comprises the nucleotide sequence of SEQ ID NO: 365. In an embodiment, the nucleic acid comprises the nucleotide sequence of SEQ ID NO: 371. In an embodiment, the nucleic acid comprises the nucleotide sequence of SEQ ID NO: 1010. In an embodiment, the nucleic acid comprises the nucleotide sequence of SEQ ID NO: 1011. In an embodiment, the nucleic acid comprises the nucleotide sequence of SEQ ID NO: 1012. In an embodiment, the nucleic acid further comprises the nucleotide sequence of SEQ ID NO: 1013. In an embodiment, the nucleic acid further comprises the nucleotide sequence of SEQ ID NO: 48. In an embodiment, the nucleic acid comprises the nucleotide sequence of SEQ ID NO: 1014. In an embodiment, the nucleic acid comprises the nucleotide sequence of SEQ ID NO: 1015. In an embodiment, the nucleic acid comprises the nucleotide sequence of SEQ ID NO: 1016. In an embodiment, the nucleic acid comprises the nucleotide sequence of SEQ ID NO: 1017. In an embodiment, the nucleic acid comprises the nucleotide sequence of SEQ ID NO: 1018. In an embodiment, the nucleic acid comprises the nucleotide sequence of SEQ ID NO: 1019.

The nucleic acids disclosed herein include deoxyribonucleotides or ribonucleotides, or analogs thereof. The polynucleotide may be either single-stranded or double-stranded, and if single-stranded may be the coding strand or noncoding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

In an aspect, the disclosure features host cells and vectors comprising the nucleic acids described herein. The nucleic acids may be present in a single vector or separate vectors present in the same host cell or separate host cell, as described in more detail below.

In an aspect, the disclosure features methods of treating a disorder (e.g., a disorder described herein) comprising administering to a subject in need thereof an effective amount of a nucleic acid described herein.

Vectors

The present disclosure features vectors that comprise a nucleotide sequence encoding an IL-2 agent described herein. In an embodiment, the vector comprises a nucleic acid described herein (e.g., in Table 10).

In an embodiment, the vector comprises a nucleotide sequence encoding an amino acid sequence of an IL-2 variant described herein (e.g., in Table 9), or a nucleotide sequence substantially identical thereto (e.g., a sequence at least about 85%, 90%, 95%, 99% or more identical thereto, and/or capable of hybridizing under the stringency conditions described herein). In an embodiment, the vector comprises a nucleotide sequence encoding an IL-2 variant comprising one or more of the mutations described herein.

In an embodiment, the vector further comprises a nucleotide sequence encoding an Fc region, e.g., an Fc region described herein, or having a nucleotide sequence substantially identical thereto (e.g., a sequence at least about 85%, 90%, 95%, 99% or more identical thereto, and/or capable of hybridizing under the stringency conditions described herein). In an embodiment, the Fc region comprises one or more mutations, e.g., one or more mutations described herein. In an embodiment, the vector comprises from 5' to 3' a nucleotide sequence encoding an IL-2 variant described herein and a nucleotide sequence encoding an Fc region described herein.

In another embodiment, the vector further comprises a nucleotide sequence encoding a linker, e.g., a linker described herein, or a nucleotide sequence substantially homologous thereto (e.g., a sequence at least about 85%, 90%, 95%, 99% or more identical thereto, and/or capable of hybridizing under the stringency conditions described herein). In an embodiment, the vector comprises from 5' to 3' a nucleotide sequence encoding an IL-2 variant described herein and a nucleotide sequence encoding a linker described herein. In an embodiment, the vector comprises from 5' to 3' a nucleotide sequence encoding a linker described herein, and a nucleotide sequence encoding an Fc region described herein.

In another embodiment, the vector comprises a nucleotide sequence encoding an IL-2 fusion protein, e.g., an IL-2 fusion protein described herein, or a nucleotide sequence substantially homologous thereto (e.g., a sequence at least about 85%, 90%, 95%, 99% or more identical thereto, and/or capable of hybridizing under the stringency conditions described herein). In an embodiment, the vector encoding the IL-2 fusion protein comprises from 5' to 3' a nucleotide sequence encoding an IL-2 variant described herein and a nucleotide sequence encoding an Fc region described herein. In an embodiment, the vector encoding the IL-2 fusion protein comprises from 5' to 3' a nucleotide sequence encoding an IL-2 variant described herein, a nucleotide sequence encoding a linker described herein, and a nucleotide sequence encoding an Fc region described herein.

In an embodiment, the vector further comprises a nucleotide sequence encoding a heavy chain variable region of an anti-IL-2 antibody molecule, e.g., an anti-IL-2 antibody molecule described herein. In an embodiment, the vector further comprises a nucleotide sequence encoding a light chain variable region of an anti-IL-2 antibody molecule, e.g., an anti-IL-2 antibody molecule described herein. In yet another embodiment, the vector further comprises a nucleotide sequence encoding a heavy chain variable region and a light chain variable region of an anti-IL-2 antibody molecule, e.g., an anti-IL-2 antibody molecule described herein.

In an embodiment, the vector further comprises a nucleotide sequence encoding at least one, two, or three CDRs from a heavy chain variable region of an anti-IL-2 antibody molecule, e.g., an anti-IL-2 antibody molecule described herein. In another embodiment, the vector further comprises a nucleotide sequence encoding at least one, two, or three CDRs from a light chain variable region of an anti-IL-2 antibody molecule, e.g., an anti-IL-2 antibody molecule described herein. In yet another embodiment, the vector comprises a nucleotide sequence encoding at least one, two, three, four, five, or six CDRs from heavy and light chain variable regions of an anti-IL-2 antibody molecule, e.g., an anti-IL-2 antibody molecule described herein.

In an embodiment, the vector comprises a portion of a nucleotide sequence described herein. The portion may encode, for example, an IL-2 variant; a liker an Fc region; a variable region (e.g., VH or VL); one, two, or three or more (e.g., four, five, or six) CDRs; or one, two, three, or four or more framework regions.

The vectors include, but are not limited to, a virus, plasmid, cosmid, lambda phage or a yeast artificial chromosome (YAC).

Numerous vector systems can be employed. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Additionally, cells which have stably integrated the DNA into their chromosomes may be selected by introducing one or more markers which allow for the selection of transfected host cells. The marker may provide, for example, prototropy to an auxotrophic host, biocide resistance (e.g., antibiotics), or resistance to heavy metals such as copper, or the like. The selectable marker gene can be either directly linked to the DNA sequences to be expressed or introduced into the same cell by cotransformation. Additional elements may also be needed for optimal synthesis of mRNA. These elements may include splice signals, as well as transcriptional promoters, enhancers, and termination signals.

Once the expression vector or DNA sequence containing the constructs has been prepared for expression, the expression vectors may be transfected or introduced into an appropriate host cell. Various techniques may be employed to achieve this, such as, for example, protoplast fusion, calcium phosphate precipitation, electroporation, retroviral transduction, viral transfection, gene gun, lipid-based transfection or other conventional techniques. In the case of protoplast fusion, the cells are grown in media and screened for the appropriate activity.

Methods and conditions for culturing the resulting transfected cells and for recovering the polypeptides (e.g., IL-2 variants or IL-2 fusion proteins) produced are known to those skilled in the art and may be varied or optimized depending upon the specific expression vector and mammalian host cell employed, based upon the present description.

Cells

The present disclosure also provides cells comprising a nucleic acid or vector encoding an IL-2 agent described herein.

In an embodiment, the cell is a host cell. For example, the host cell can comprise an IL-2 agent engineered in accordance with a method described herein. In an embodiment, the cell is an isolated cell. In an embodiment, the cell is a cultured cell.

In an embodiment, the cell comprises a nucleic acid comprising a nucleotide sequence encoding an IL-2 agent described herein (e.g., in Table 10), a nucleotide sequence substantially homologous thereto (e.g., a sequence at least about 85%, 90%, 95%, 99% or more identical thereto, and/or capable of hybridizing under the stringency conditions described herein), or a portion of the aforesaid nucleic acid. In an embodiment, the cell comprises a vector comprising a nucleotide sequence encoding an IL-2 agent described herein, a nucleotide sequence substantially homologous thereto (e.g., a sequence at least about 85%, 90%, 95%, 99% or more identical thereto, and/or capable of hybridizing under the stringency conditions described herein), or a portion of the aforesaid vector.

In an embodiment, the cell is genetically engineered to comprise a nucleic acid or vector encoding an IL-2 agent described herein. In an embodiment, the host cells are genetically engineered by using an expression cassette. The phrase "expression cassette," refers to nucleotide sequences, which are capable of affecting expression of a gene in hosts compatible with such sequences. Such cassettes may include a promoter, an open reading frame with or without introns, and a termination signal. Additional factors necessary or helpful in effecting expression may also be used, for example, an inducible promoter.

The cell can be, but is not limited to, a eukaryotic cell, a bacterial cell, an insect cell, or a human cell. Suitable eukaryotic cells include, but are not limited to, Vero cells, HeLa cells, COS cells, CHO cells, HEK293 cells, BHK cells and MDCKII cells. Suitable insect cells include, but are not limited to, Sf9 cells.

Uses of IL-2 Agents

The IL-2 agents (e.g., IL-2 variants, fusion polypeptides, complexes, or immunoconjugates) described herein, as well as the compositions described herein and the nucleic acids described herein, have in vitro, ex vivo, and in vivo therapeutic, prophylactic, and/or diagnostic utilities.

In an embodiment, the IL-2 agent modulates (e.g., reduces (e.g., inhibits, blocks, or neutralizes) or increases (e.g., activates, initiates, or enhances)) one or more biological activities associated with IL-2. For example, these IL-2 agents can be administered to cells in culture, in vitro or ex vivo, or to a subject, e.g., a human subject, e.g., in vivo, to modulate one or more biological activities associated with IL-2. Accordingly, in an aspect, the disclosure provides a method of treating, preventing, or diagnosing a disorder, e.g., a disorder described herein, in a subject, comprising administering to the subject an IL-2 agent described herein, such that the disorder is treated, prevented, or diagnosed. For example, the disclosure provides a method comprising contacting the IL-2 agent described herein with cells in culture, e.g., in vitro or ex vivo, or administering the IL-2 agent described herein to a subject, e.g., in vivo, to treat, prevent, or diagnose a disorder, e.g., a disorder associated with IL-2 (e.g., a disorder described herein).

As used herein, the term "subject" is intended to include human and non-human animals. In an embodiment, the subject is a human subject, e.g., a human patient having a disorder described herein, or at risk of having a disorder described herein. The term "non-human animals" includes mammals and non-mammals, such as non-human primates. In an embodiment, the subject is a human. The methods and compositions described herein are suitable for treating human patients for a disorder described herein. Patients having a disorder described herein include those who have developed a disorder described herein but are (at least temporarily) asymptomatic, patients who have exhibited a symptom of a disorder described herein, or patients having a disorder related to or associated with a disorder described herein.

Without wishing to be bound by theory, it is believed that in an embodiment, the IL-2 agents described herein selectively stimulate regulatory T cells (Tregs). For example, the IL-2 agents described herein can promotes the proliferation, survival, activation, and/or function of CD3+FoxP3+ T cells over CD3+FoxP3− T cells. Methods of measuring the ability to selectively stimulate Tregs can be measured by flow cytometry of peripheral blood leukocytes, in which there is an observed increase in the percentage of FOXP3+CD4+ T cells among total CD4+ T cells, an increase in percentage of FOXP3+CD8+ T cells among total CD8+ T cells, an increase in percentage of FOXP3+ T cells relative to NK cells, and/or a greater increase in the expression level of CD25 on the surface of FOXP3+ T cells relative to the increase of CD25 expression on other T cells. Preferential growth of Treg cells can also be detected as increased representation of demethylated FOXP3 promoter DNA (i.e., the Treg-specific demethylated region, or TSDR) relative to demethylated CD3 genes in DNA extracted from whole blood, as detected by sequencing of polymerase chain reaction (PCR) products from bisulfite-treated genomic DNA (J. Sehouli, et al. 2011. Epigenetics 6:2, 236-246). Without wishing to be bound by theory, it is believed that in an embodiment, the IL-2 agents described agents can achieve immune modulation through selective activation of regulatory T cells, resulting in T reg stimulation with minimal effect on T effector and NK cells. The IL-2 agents described herein are particularly suitable for treating transplant rejection, e.g., heart transplant rejection. In an embodiment, the IL-2 agent results in immune modulation without immunosuppression, which is highly desired in an IL-2 therapy.

In an aspect, the disclosure provides a method of increasing the ratio of regulatory T cells (Tregs) to non-regulatory T cells (non-Tregs) within a population of T cells, comprising contacting the population of T cells with an effective amount of an IL-2 agent described herein.

In an embodiment, the IL-2 agent selectively increases the ratio of Tregs over non-Tregs by about 20%, 30%, 40%, 50%, 60%, 70%, 80%, 90%, 100%, or more, or about 2, 3, 4, 5, 6, 7, 8, 9, 10-fold or more. In an embodiment, the IL-2 agent selectively increases the ratio of CD3+FoxP3+ cells to CD3+FoxP3− cells by about 20%, 30%, 40%, 50%, 60%, 70%, 80%, 90%, 100%, or more, or about 2, 3, 4, 5, 6, 7, 8, 9, 10-fold or more.

In an aspect, the disclosure provides a method of increasing the ratio of regulatory T cells (Tregs) to non-regulatory T cells (non-Tregs) in a subject (e.g., in the peripheral blood of a subject), comprising contacting the subject or sample with an effective amount of an IL-2 agent described herein.

In an embodiment, the IL-2 agent selectively increases the ratio of Tregs over non-Tregs in the subject, or in a sample (e.g., a peripheral blood sample) from the subject, by about 20%, 30%, 40%, 50%, 60%, 70%, 80%, 90%, 100%, or more, or about 2, 3, 4, 5, 6, 7, 8, 9, 10-fold or more. In an embodiment, the IL-2 agent selectively increases the ratio of CD3+FoxP3+ cells to CD3+FoxP3− cells in the subject, or in a sample (e.g., a peripheral blood sample) from the subject, by about 20%, 30%, 40%, 50%, 60%, 70%, 80%, 90%, 100%, or more, or about 2, 3, 4, 5, 6, 7, 8, 9, 10-fold or more.

In an aspect, the disclosure provides a method of increasing the ratio of regulatory T cells (Tregs) to natural killer cells (NKs) in a subject (e.g., in the peripheral blood of a subject), comprising contacting the subject or sample with an effective amount of an IL-2 agent described herein.

In an embodiment, the IL-2 agent selectively increases the ratio of Tregs over NKs in the subject, or in a sample (e.g., a peripheral blood sample) from the subject, by about 20%, 30%, 40%, 50%, 60%, 70%, 80%, 90%, 100%, or more, or about 2, 3, 4, 5, 6, 7, 8, 9, 10-fold or more. In an embodiment, the IL-2 agent selectively increases the ratio of CD3+FoxP3+ cells to CD3−CD19− lymphocytes expressing CD56 and/or CD16 in the subject, or in a sample (e.g., a peripheral blood sample) from the subject, by about 20%, 30%, 40%, 50%, 60%, 70%, 80%, 90%, 100%, or more, or about 2, 3, 4, 5, 6, 7, 8, 9, 10-fold or more.

Methods of Treating or Preventing Disorders

The IL-2 agents (e.g., IL-2 variants, fusion polypeptides, complexes, or immunoconjugates) described herein, as well as the pharmaceutical compositions disclosed herein and the nucleic acids described herein, can be used to treat or prevent various disorders or conditions.

In an embodiment, the disorder is a transplant rejection. In an embodiment, the disorder is a heart transplant rejection. In an embodiment, the disorder is a heart disease, e.g., a heart disease that can be treated by a heart transplant.

The IL-2 agents described herein can have an optimal or improved half-life, which can be desirable for treating or preventing a wide range of disorders or conditions. While not wishing to be bound by theory, it is believed that in an embodiment, the IL-2 agents described herein can provide one or more benefits over another IL-2 agent having the same or similar binding affinity and/or specificity (e.g., an IL-2 agent that does not have, or has not been engineered to have, an optimal or improved half-life). These benefits can include, but are not limited to, an increased therapeutic or preventive efficacy, a reduced dosage regimen, or an improved pharmacokinetic property. In an embodiment, the IL-2 includes a mutated Fc region as described herein.

In an embodiment, the ratio of regulatory T cells (Tregs) to non-regulatory T cells within the subject (e.g., in the peripheral blood of the subject) increases after the administration. In an embodiment, the ratio of regulatory T cells (Tregs) to non-regulatory T cells within the subject (e.g., in the peripheral blood of the subject) remains essentially the same after the administration. In an embodiment, the method further comprises identifying a subject who needs an increased level of Tregs. In an embodiment, the method further comprises determining the level of Tregs in the subject prior to and/or after the administration.

The IL-2 agents described herein are typically administered at a frequency that keeps a therapeutically effective level of IL-2 agents in the patient's system until the patient recovers. For example, the IL-2 agents may be administered at a frequency that achieves a serum concentration sufficient for at least about 1, 2, 5, 10, 20, 30, or 40 agents to bind each target molecule or cell. In an embodiment, the IL-2 agent is administered every 1, 2, 3, 4, 5, 6, or 7 days, every 1, 2, 3, 4, 5, or 6 weeks, or every 1, 2, 3, 4, 5, or 6 months. In an embodiment, the IL-2 agent is administered once a month. In an embodiment, the IL-2 agent is administered once a week.

Methods of administering various agents (e.g., antibody molecules or fusion proteins) are known in the art and are described below. Suitable dosages of the agents used will depend on the age and weight of the subject and the particular drug used.

In an embodiment, the ratio of regulatory T cells (Tregs) to non-regulatory T cells within the subject (e.g., in the peripheral blood of the subject) increases after the administration. In an embodiment, the ratio of regulatory T cells (Tregs) to non-regulatory T cells within the subject (e.g., in the peripheral blood of the subject) remains essentially the same after the administration.

The IL-2 agents can be used by themselves or conjugated to a second agent, e.g., a protein, e.g., an antibody molecule, a polymer (e.g., polyethylene glycol (PEG)), or a cytokine. In an embodiment, the second agent comprises a second IL-2 agent. This method includes administering the IL-2 agent, alone or conjugated to a second agent, to a subject requiring such treatment.

Combination Therapies

The IL-2 agents (e.g., e.g., IL-2 variants, IL-2 fusion proteins, IL-2 complexes, or IL-2 conjugates) described herein, as well as the pharmaceutical compositions disclosed herein, can be used in combination with other therapies.

For example, the combination therapy can include an IL-2 agent described herein co-formulated with, and/or co-administered with, one or more additional therapeutic agents, e.g., one or more additional therapeutic agents described herein. In other embodiments, the IL-2 agents are administered in combination with other therapeutic treatment modalities, e.g., other therapeutic treatment modalities described herein. Such combination therapies may advantageously utilize lower dosages of the administered therapeutic agents, thus avoiding possible toxicities or complications associated with the various monotherapies.

Administered "in combination," as used herein, means that two (or more) different treatments are delivered to the subject before, or during the course of the subject's affliction with a disorder. In an embodiment, two or more treatments are delivered prophylactically, e.g., before the subject has the disorder or is diagnosed with the disorder. In another embodiment, the two or more treatments are delivered after the subject has developed or diagnosed with the disorder. In an embodiment, the delivery of one treatment is still occurring when the delivery of the second begins, so that there is overlap. This is sometimes referred to herein as "simultaneous" or "concurrent delivery." In other embodiments, the delivery of one treatment ends before the delivery of the other treatment begins. In an embodiment of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In an embodiment, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

In an embodiment, the IL-2 agent is administered in combination with a second therapy (e.g., an additional agent) to treat or prevent a disorder described herein. In an embodiment, the additional agent is a second IL-2 agent, e.g., an IL-2 agent different from a first IL-2 agent. Exemplary IL-2 agents that can be used in combination include, but are not limited to, any combination of the IL-2 agents described herein. In another embodiment, the additional agent is other than an IL-2 agent. For example, the additional agent can be a small molecule or a nucleic acid molecule. In yet another embodiment, the second therapy is a transplant, e.g., a heart transplant. In an embodiment, the second therapy comprises an immunosuppressive agent. In an embodiment, the immunosuppressive agent comprises rapamycin.

ENUMERATED EMBODIMENTS

1. A method of treating a transplant rejection or a symptom thereof, comprising administering to a subject in need thereof an effective amount of an IL-2 agent described herein, e.g., an IL-2 variant described herein, or an IL-2 fusion protein described herein, thereby treating the transplant rejection or the symptom thereof.

2. A method of preventing a transplant rejection or a symptom thereof, comprising administering to a subject in need thereof an effective amount of an IL-2 agent described herein, e.g., an IL-2 variant described herein, or an IL-2 fusion protein described herein, thereby preventing the transplant rejection or the symptom thereof.

3. A method of modulating (e.g., increasing or inducing) immunosuppression for a transplant, comprising administering to a subject in need thereof an effective amount of an IL-2 agent described herein, e.g., an IL-2 variant described herein, or an IL-2 fusion protein described herein, thereby modulating (e.g., increasing or inducing) immunosuppression for a transplant.

4. The method of any of embodiments 1-3, wherein the subject has received, is receiving, or will receive a transplant, when the IL-2 agent is administered to the subject.

5. A method of conditioning a subject prior to a transplant, comprising administering to a subject in need thereof an effective amount of an IL-2 agent described herein, e.g., an IL-2 variant described herein, or an IL-2 fusion protein described herein, thereby conditioning the subject prior to the transplant.

6. A method of selectively increasing Tregs, comprising administering to a subject in need thereof an effective amount of an IL-2 agent described herein, e.g., an IL-2 variant described herein, or an IL-2 fusion protein described herein, wherein the subject has received, is receiving, or will receive a transplant, thereby selectively increasing Tregs.

7. The method of any of embodiments 1-6, wherein the transplant is a heart transplant.

8. A method of treating a heart disease or a symptom thereof, comprising:

administering to a subject in need thereof an effective amount of an IL-2 agent described herein, e.g., an IL-2 variant described herein, or an IL-2 fusion protein described herein; and providing a heart transplant to the subject, thereby treating the heart disease or the symptom thereof.

9. The method of embodiment 8, wherein the heart transplant is provided to the subject prior to, concurrent with, or after administration of the IL-2 fusion protein.

10. The method of any of embodiments 1-9, wherein the level of Tregs in the subject is increased by about 2, 3, 4, 5, 6, 7, 8, 9, 10-fold or more, compared to the level of Tregs in the subject prior to administration of the IL-2 fusion protein.

11. The method of embodiment 10, wherein the level of Tregs is determined in a sample from the subject.

12. The method of any of embodiments 1-11, wherein the IL-2 fusion protein comprises an IL-2 variant comprising:

(i) (a) the amino acid substitution H16L or H16N, (b) the amino acid substitution I92S, or (c) both (a) and (b); and (ii) the amino acid substitutions V69A, Q74P, and C125S, corresponding to human IL-2 (SEQ ID NO: 1031), 13. The method of embodiment 12, wherein the IL-2 variant further comprises the amino acid substitution T3A.

14. The method of any of embodiments 1-13, wherein the IL-2 variant comprises the amino acid sequence of any of SEQ ID NOs: 4, 5, 11, 1000, 1001, or 1002, an amino acid sequence that is at least 95% identical thereto or differs by no more than 1, 2, 3, 4, or 5 amino acids therefrom, or a functional fragment thereof.

15. The method of any of embodiments 1-14, wherein the IL-2 fusion protein further comprises an Fc region.

16. The method of embodiment 15, wherein the Fc region comprises an Fc region of IgG1 allotype m3 comprising an N297G substitution according to EU numbering.

17. The method of embodiment 15 or 16, wherein the Fc region comprises the amino acid sequence of SEQ ID NO: 1003, or an amino acid sequence that is at least 95% identical thereto or differs by no more than 1, 2, 3, 4, 5, 6, 7, 8, 9, or 10 amino acids therefrom, or a functional fragment thereof.

18. The method of any of embodiments 15-17, wherein the Fc region is fused to the C-terminus of the IL-2 variant.

19. The method of any of embodiments 1-18, wherein the IL-2 fusion protein further comprises a linker.

20. The method of embodiment 19, wherein the linker comprises $(G_4S)_4$ (SEQ ID NO: 48).

21. The method of any of embodiments 1-20, wherein the fusion protein comprises an amino acid sequence of any of SEQ ID NOs: 1004, 1005, 1006, 1007, 1008, or 1009, an amino acid sequence that is at least 95% identical thereto or differs by no more than 1, 2, 3, 4, 5, 6, 7, 8, 9, or 10 amino acids therefrom, or a functional fragment thereof.

22. The method of any of embodiments 1-21, wherein the fusion protein forms a dimer.

23. The method of any of embodiments 1-22, further comprising administering an immunosuppressive agent to the subject.

24. The method of embodiment 23, wherein the immunosuppressive agent comprises rapamycin.

25. The method of any of embodiments 1-24, wherein the subject is a human or a non-human primate.

26. The method of any of embodiments 1-24, wherein the subject is a mouse.

27. A combination comprising an IL-2 agent described herein, e.g., an IL-2 variant described herein, or an IL-2 fusion protein described herein, and a transplant.

28. The combination of embodiment 27, wherein the transplant is a heart transplant.

29. The combination of embodiment 27 or 28, further comprising one or more additional immunosuppressive agents, e.g., rapamycin.

30. The combination of any of embodiment 27-29 for use in treating or preventing a transplant rejection in a subject.

31. The combination for use of embodiment 30, wherein the transplant rejection is a heart transplant rejection.

32. The combination for use of embodiment 30 or 31, wherein the IL-2 agent is administered to the subject prior to, during, and/or after the transplant.

33. The combination of any of embodiments 27-29 for use in modulating (e.g., increasing or inducing), immunosuppression in a subject.

34. The combination of any of embodiments 27-29 for use in selectively increasing T regulatory cells in a subject.

35. The combination of any of embodiments 30-34, wherein the subject is a human or a non-human primate.

36. The combination of any of embodiments 30-34, wherein the subject is a mouse.

Examples

Example 1: IL-2 Mutein Therapy Induces FOXP3+ Treg Expansion and Donor-Specific Allograft Tolerance

Figure 3:
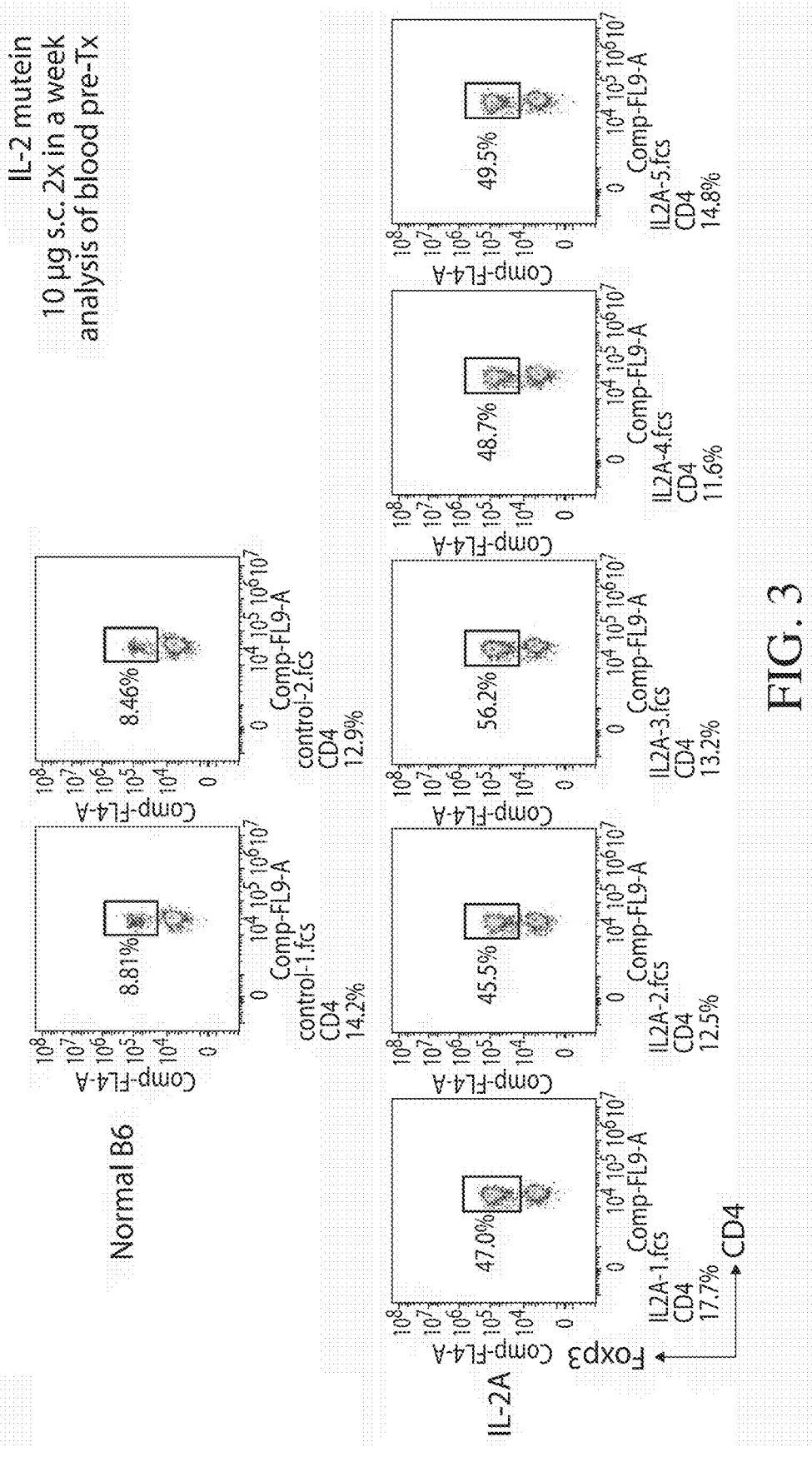
FIG. 3 is a series of flow cytometry plots showing expansion of circulating Tregs in vivo by injected an exemplary IL-2 mutein. 10 ug of IL-2 mutein were administered subcutaneously twice in a week. Analysis of blood pre-Tx is shown. X-axis indicates CD4 expression and y-axis indicates Foxp3 expression.

The ability of human IL-2, engineered with amino acid mutations to promote its binding to CD25 vs. CD122 or CD132 and fused to human Fc to promote its half-life in vivo, was evaluated as a tool to enhance Foxp3+ Treg functions in murine allograft recipients. In the presence of TGF-b, an exemplary IL-2 mutein (IL-2m) described herein induced Stat5b phosphorylation and promoted inducible Treg development in vitro by 5-fold (FIGS. 1A, 1B, 2A, and 2B), and by 8-fold when used in conjunction with a Cdk8/ 19i. Similarly, upon injection in vivo (10 μg s.c. twice/ week), the IL-2 mutein expanded the Foxp3+ Treg population by 4-5-fold (FIG. 3).

Figure 4:
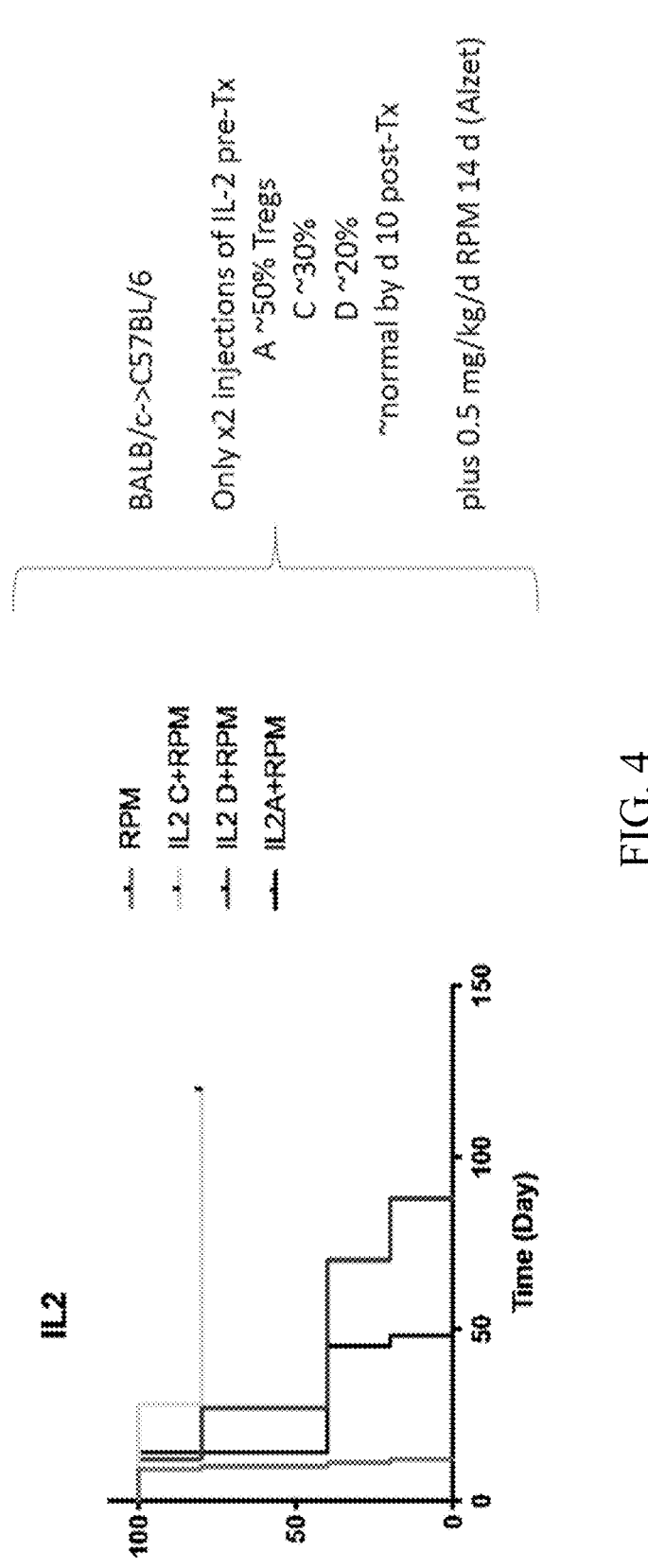
FIG. 4. is a graph showing the survival of a murine allograft model (BALB/c→C57BL/6). Mice received RPM alone or two injections of IL-2 mutein pre-Tx, plus 0.5 mg/kg/d RPM for 14d (Alzet). Pre-transplant an exemplary IL-2 mutein (IL-2C) prolonged murine cardiac allograft survival for >100 days. IL-2A mutein ~50% Tregs, IL-2C mutein Tregs ~30%, IL-2D mutein ~20% Tregs, ~normal by d 10 post-Tx.
Figure 5:
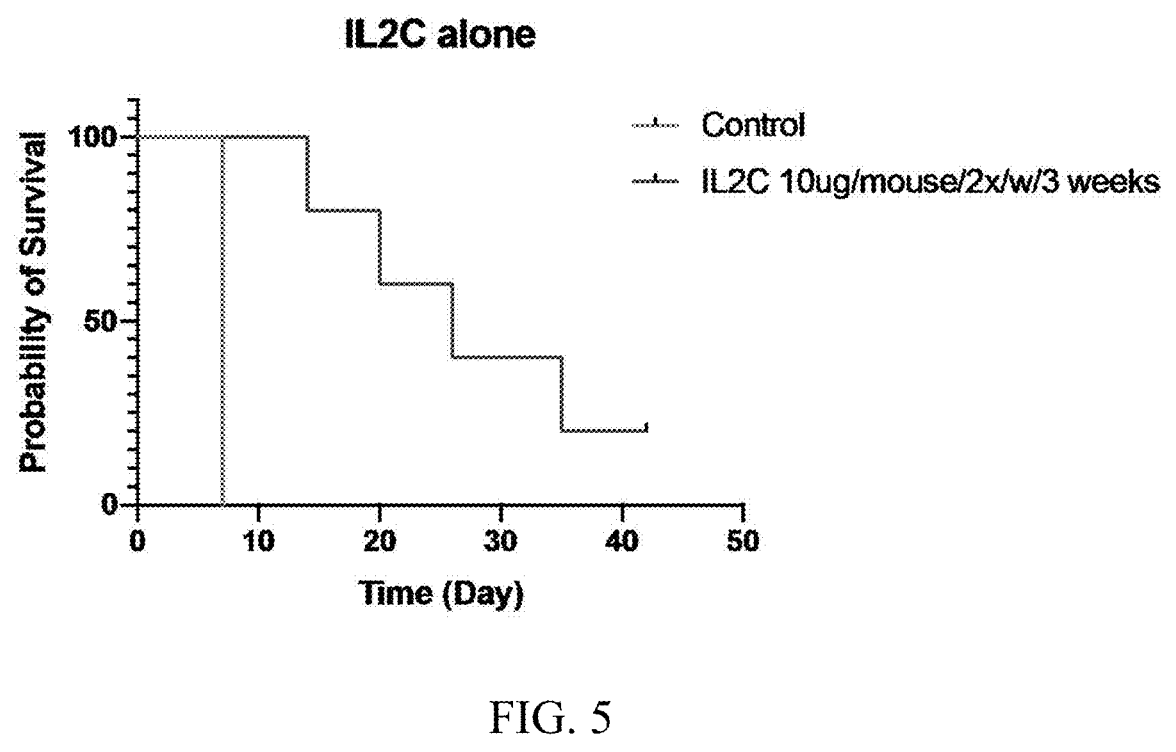
Figures 6A, 6B:
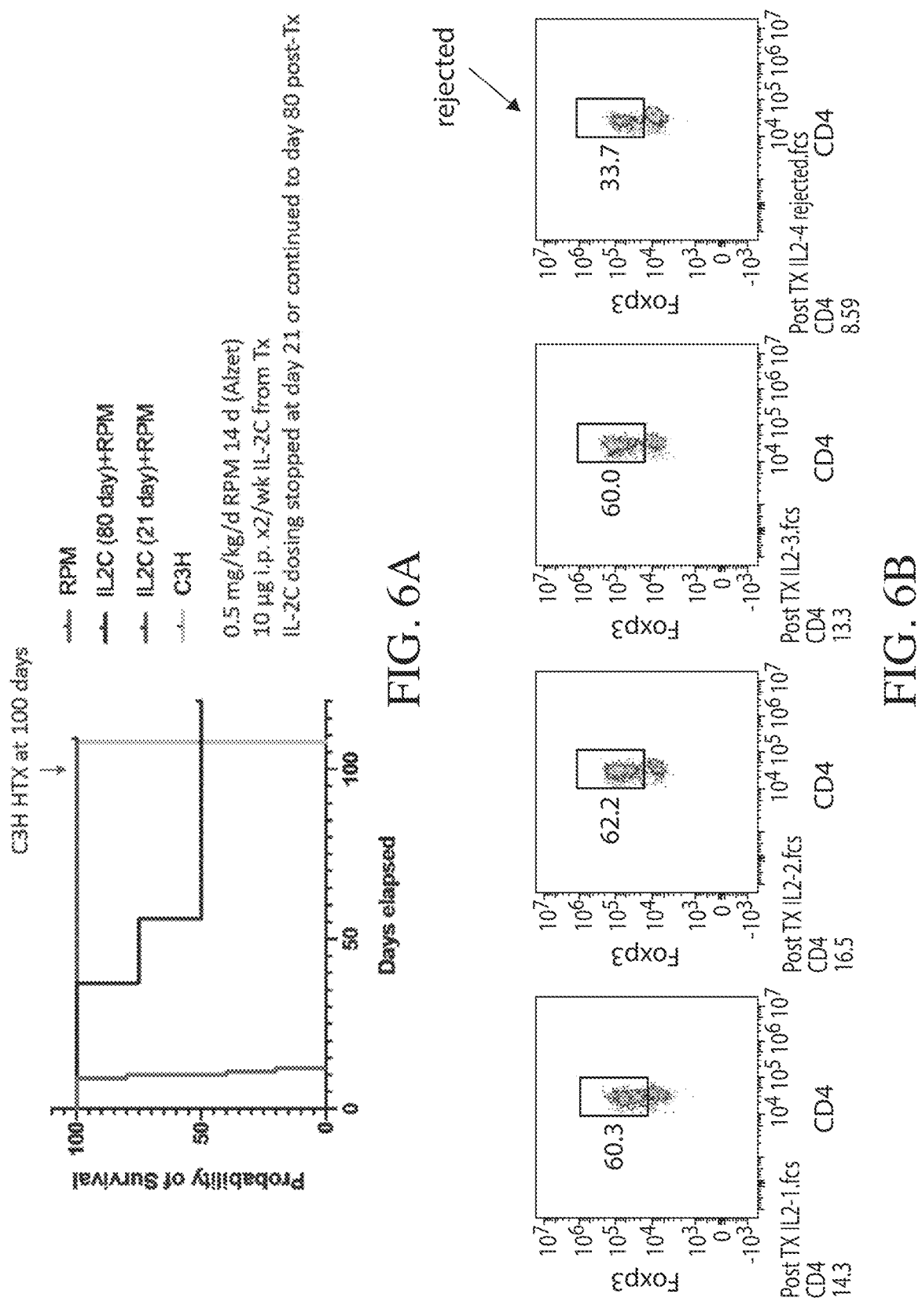
FIG. 6A is a graph showing the survival of a murine cardiac allograft model (BALB/c→C57BL/6, 4-5/group) receiving RPM alone or IL-2C mutein (10 ug i.p.×2/wk IL-2C from Tx) with RPM (0.5 mg/kg/d RPM 14d (Alzet)) post-transplant. Il-2C mutein dosing was stopped at day 21 or continued to day 80 post-Tx. C3H cardiac allografts were received at 100 days. The results demonstrate that limited post-transplant IL-2C mutein prolonged murine cardiac allograft survival through the end of the study period.
FIG. 6B is a series of flow cytometry plots depicting CD4 expression (x-axis) and Foxp3 expression (y-axis), related to the murine cardiac allograft model and treatment shown in FIG. 6A. The right-most flow cytometry plot corresponds to recipients with rejection.
Figure 7:
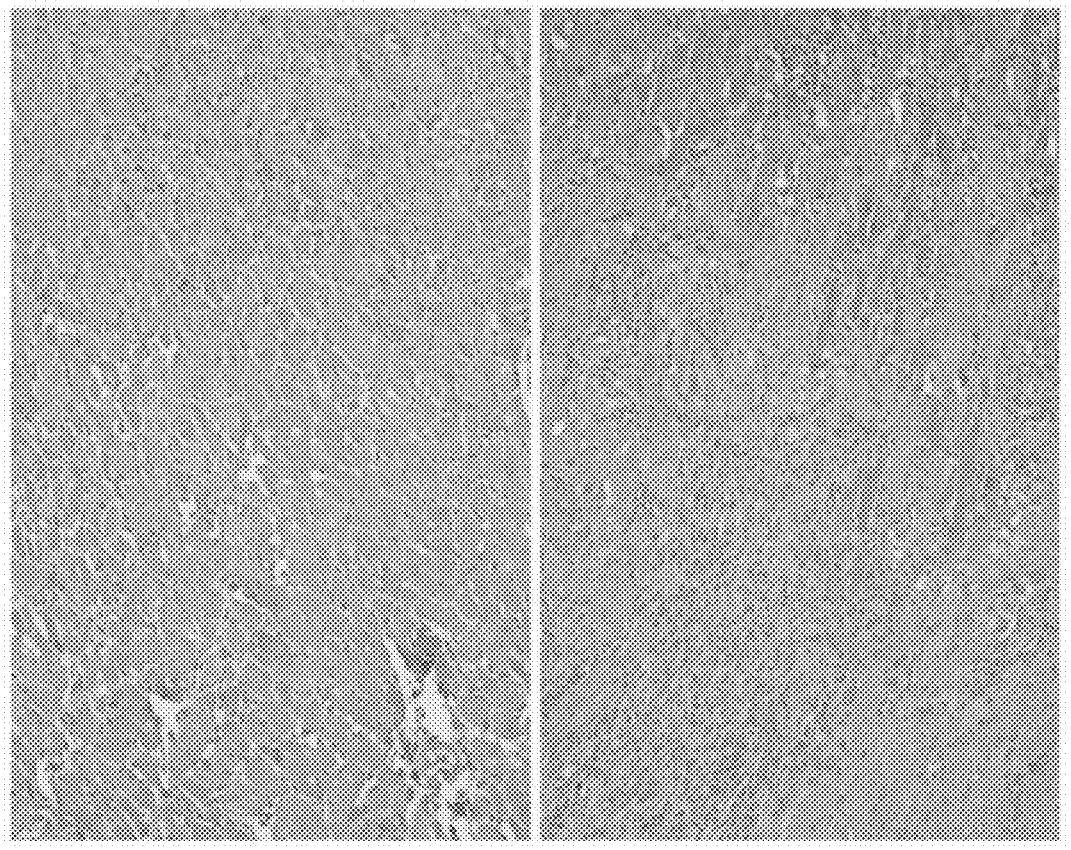
FIG. 7 are histological images showing donor-specific tolerance induced by IL-2C mutein therapy. Shown are cardiac tissue from recipients after >110 d continued acceptance of BALB/c cardiac allografts (left) and acute rejection of C3H cardiac allografts within 8-9d (right). 3 weeks of IL-2C and 14 d low-dose RPM was administered, N=5/group, H&E, ×200. Donor-specific tolerance was induced by IL-2C mutein therapy.

The effects of IL-2 mutein therapy were therefore tested in a fully MHC-mismatched cardiac allograft model (BALB/c→C57BL/6) in which recipients also received low-dose rapamycin (RPM, 0.5 mg/kg/d via Alzet pump for 2 wk post-Tx). Two injections of an exemplary IL-2 mutein (IL-2C) 10 µg s.c. twice in the week pre-Tx, plus low dose RPM for 2 weeks led to 80% long-term survival (>100 d, p<0.01 vs. RPM alone; FIG. 4) but acutely rejected (7-8 d) third-party C3H allografts when challenged at >100 d. Efficacy of post-Tx an exemplary IL-2 mutein (IL-2C) therapy alone in murine cardiac allograft recipients (BALB/c→C57BL/6) was also assessed (FIG. 5). In a more clinically relevant protocol, the same dose of the IL-2 mutein for 3 wks post-Tx, in conjunction with low-dose RPM for 2 weeks, resulted in 100% survival for >100 d (p<0.01 vs. RPM alone) and again was associated with the rapid (7-8 d) rejection of third-party C3H challenge allografts (FIGS. 6A and 6B). Histologic examination of BALB/c allografts at >100 d post-Tx showed excellent myocardial preservation, normal vessels and only minor focal mononuclear cell infiltrates (FIG. 7). These results demonstrate that pre- and post-Tx therapy with an IL-2 mutein described herein prolonged allograft survival, especially when combined with a brief subtherapeutic course of RPM. In summary, brief therapy with an IL-2 mutein described herein can expand recipient Treg cells and induce donor-specific allograft tolerance. IL-2 muteins promote iTreg development in vitro and in vivo. Their efficacy is superior to that of native IL-2 in terms of promoting murine allograft survival.

Other aspects, embodiments, examples, and figures are described in International Application Publication No. WO 2021/021606, the contents of which are incorporated by references in their entirety.

INCORPORATION BY REFERENCE

All publications, patents, and Accession numbers mentioned herein are hereby incorporated by reference in their entirety as if each individual publication or patent was specifically and individually indicated to be incorporated by reference.

EQUIVALENTS

While specific embodiments of the subject invention have been discussed, the above specification is illustrative and not restrictive. Many variations of the invention will become apparent to those skilled in the art upon review of this specification and the claims below. The full scope of the invention should be determined by reference to the claims, along with their full scope of equivalents, and the specification, along with such variations.

TABLE 9

Description of Exemplary Amino Acid Sequences

| SEQ ID NO | Description | Substitutions |
|---|---|---|
| | Exemplary IL-2 Variants (Muteins) | |
| 1 | IL2 C125S | C125S |
| 2 | Stabilized IL-2 | V69A/Q74P/C125S |
| 3 | IL2-037 | H16D/V69A/Q74P/C125S |
| 4 | IL2-062 | H16N/V69A/Q74P/C125S |
| 5 | IL2-118 | H16L/V69A/Q74P/C125S |
| 6 | IL2-035 | I28T/V69A/Q74P/C125S |
| 7 | IL2-073 | V69A/Q74P/D84V/C125S |

TABLE 9-continued

| 8 | IL2-077 | V69A/Q74P/S87R/C125S |
|---|---|---|
| 9 | IL2-043 | V69A/Q74P/N88L/C125S |
| 10 | IL2-036 | V69A/Q74P/N88S/C125S |
| 11 | IL2-068 | V69A/Q74P/I92S/C125S |
| 12 | IL2-106 | K35E/V69A/Q74P/C125S |
| 13 | IL2-107 | K35E/H16N/V69A/Q74P/C125S |
| 14 | IL2-119 | K35E/H16L/V69A/Q74P/C125S |
| 15 | K35E/D84V mutein | K35E/D84V/V69A/Q74P/C125S |
| 16 | IL2-115 | K35E/I92S/V69A/Q74P/C125S |
| 17 | IL2-109 | R38Q/V69A/Q74P/C125S |
| 18 | IL2-113 | R38Q/H16N/V69A/Q74P/C125S |
| 19 | IL2-120 | R38Q/H16L/V69A/Q74P/C125S |
| 20 | R38Q/D84V mutein | R38Q/D84V/V69A/Q74P/C125S |
| 21 | IL2-116 | R38Q/I92S/Q74P/C125S |
| 22 | IL2-088 | R38N/V69A/Q74P/C125S |
| 23 | IL2-097 | R38N/H16N/V69A/Q74P/C125S |
| 24 | R38N/H16L mutein | R38N/H16L/V69A/Q74P/C125S |
| 25 | IL2-098 | R38N/D84V/V69A/Q74P/C125S |
| 26 | IL2-100 | R38N/I92S/Q74P/C125S |
| 27 | IL2-090 | R38E/V69A/Q74P/C125S |
| 28 | IL2-092 | F42K/V69A/Q74P/C125S |
| 29 | IL2-110 | F42Q/V69A/Q74P/C125S |
| 30 | IL2-Inactive | F42A/Y45A/L72G/N88D/V69A/Q74P/C125S |
| 31 | IL2-99 | R38N/S87R/V69A/Q74P/C125S |
| 32 | IL2-101 | R38E/H16N/V69A/Q74P/C125S |
| 33 | IL2-102 | R38E/D84V/V69A/Q74P/C125S |
| 34 | IL2-103 | R38E/S87R/V69A/Q74P/C125S |
| 35 | IL2-104 | R38E/I92S/V69A/Q74P/C125S |
| 36 | IL2-114 | F42Q/H16N/V69A/Q74P/C125S |
| 37 | IL2-117 | F42Q/I92S/V69A/Q74P/C125S |
| 38 | IL2-108 | K35E/R38N/H16N/V69A/Q74P/C125S |
| 1000 | IL2-124 | T3A/H16N/V69A/Q74P/C125S |
| 1001 | IL2-127 | T3A/H16L/V69A/Q74P/C125S |
| 1002 | IL2-130 | T3A/I92S/V69A/Q74P/C125S |
| | Exemplary Fc Regions | |
| 39 | IgG1 Fc | |
| 40 | IgG1 Fc N297G | N297G |
| 41 | IgG1 Fc LALAPG | L234A/L235A/P329G |
| 42 | IgG1 Fc N297G Mut215 | N297G/T307Q/Q311V/A378V |
| 43 | IgG1 Fc LALAPG Mut215 | L234A/L235A/P329G/T307Q/Q311V/A378V |
| 44 | IgG4 Fc S228P | S228P |
| 45 | IgG4 Fc S228P/R409K | S228P/R409K |
| 46 | IgG4 Fc S228P Mut215 | S228P/T307Q/Q311V/A378V |
| 47 | IgG4 Fc S228P/R409K Mut215 | S228P/R409K/T307Q/Q311V/A378V |
| 1003 | IgG1 Fc N297G m3 allotype | |
| | Linkers | |

| SEQ ID NO | Description |
|---|---|
| 48 | (G4S)4 linker |
| 49 | Linker v1 |
| 50 | Linker v2 |
| 51 | Linker v3 |
| 52 | Linker v4 |
| 53 | Linker v5 |
| 54 | Linker v6 |
| 55 | Linker v7 |
| | Exemplary IL-2-Fc Fusion Proteins (IgG1 Fc N297G) |
| 56 | IL2 C125S fused to IgG1 Fc N297G |
| 57 | Stabilized IL-2 fused to IgG1 Fc N297G |
| 58 | IL2-037 fused to IgG1 Fc N297G |
| 59 | IL2-062 fused to IgG1 Fc N297G |
| 60 | IL2-118 fused to IgG1 Fc N297G |
| 61 | IL2-035 fused to IgG1 Fc N297G |
| 62 | IL2-073 fused to IgG1 Fc N297G |
| 63 | IL2-077 fused to IgG1 Fc N297G |
| 64 | IL2-043 fused to IgG1 Fc N297G |
| 65 | IL2-036 fused to IgG1 Fc N297G |

TABLE 9-continued

| | |
|---|---|
| 66 | IL2-068 fused to IgG1 Fc N297G |
| 67 | IL2-106 fused to IgG1 Fc N297G |
| 68 | IL2-107 fused to IgG1 Fc N297G |
| 69 | IL2-119 fused to IgG1 Fc N297G |
| 70 | K35E/D84V mutein fused to IgG1 Fc N297G |
| 71 | IL2-115 fused to IgG1 Fc N297G |
| 72 | IL2-109 fused to IgG1 Fc N297G |
| 73 | IL2-113 fused to IgG1 Fc N297G |
| 74 | IL2-120 fused to IgG1 Fc N297G |
| 75 | R38Q/D84V mutein fused to IgG1 Fc N297G |
| 76 | IL2-116 fused to IgG1 Fc N297G |
| 77 | IL2-088 fused to IgG1 Fc N297G |
| 78 | IL2-097 fused to IgG1 Fc N297G |
| 79 | R38N/H16L mutein fused to IgG1 Fc N297G |
| 80 | IL2-098 fused to IgG1 Fc N297G |
| 81 | IL2-100 fused to IgG1 Fc N297G |
| 82 | IL2-090 fused to IgG1 Fc N297G |
| 83 | IL2-092 fused to IgG1 Fc N297G |
| 84 | IL2-110 fused to IgG1 Fc N297G |
| 85 | IL2-Inactive fused to IgG1 Fc N297G |
| 86 | IL2-99 fused to IgG1 Fc N297G |
| 87 | IL2-101 fused to IgG1 Fc N297G |
| 88 | IL2-102 fused to IgG1 Fc N297G |
| 89 | IL2-103 fused to IgG1 Fc N297G |
| 90 | IL2-104 fused to IgG1 Fc N297G |
| 91 | IL2-114 fused to IgG1 Fc N297G |
| 92 | IL2-117 fused to IgG1 Fc N297G |
| 93 | IL2-108 fused to IgG1 Fc N297G |
| 1004 | IL2-124 fused to IgG1 Fc N297G allotype m3 |
| 1005 | IL2-127 fused to IgG1 Fc N297G allotype m3 |
| 1006 | IL2-130 fused to IgG1 Fc N297G allotype m3 |
| 1007 | IL2-062 fused to IgG1 Fc N297G allotype m3 |
| 1008 | IL2-118 fused to IgG1 Fc N297G allotype m3 |
| 1009 | IL2-068 fused to IgG1 Fc N297G allotype m3 |
| | IL-2-Fc Fusion Proteins (IgG1 Fc LALAPG) |
| 94 | IL2 C125S fused to IgG1 Fc LALAPG |
| 95 | Stabilized IL-2 fused to IgG1 Fc LALAPG |
| 96 | IL2-037 fused to IgG1 Fc LALAPG |
| 97 | IL2-062 fused to IgG1 Fc LALAPG |
| 98 | IL2-118 fused to IgG1 Fc LALAPG |
| 99 | IL2-035 fused to IgG1 Fc LALAPG |
| 100 | IL2-073 fused to IgG1 Fc LALAPG |
| 101 | IL2-077 fused to IgG1 Fc LALAPG |
| 102 | IL2-043 fused to IgG1 Fc LALAPG |
| 103 | IL2-036 fused to IgG1 Fc LALAPG |
| 104 | IL2-068 fused to IgG1 Fc LALAPG |
| 105 | IL2-106 fused to IgG1 Fc LALAPG |
| 106 | IL2-107 fused to IgG1 Fc LALAPG |
| 107 | IL2-119 fused to IgG1 Fc LALAPG |
| 108 | K35E/D84V mutein fused to IgG1 Fc LALAPG |
| 109 | IL2-115 fused to IgG1 Fc LALAPG |
| 110 | IL2-109 fused to IgG1 Fc LALAPG |
| 111 | IL2-113 fused to IgG1 Fc LALAPG |
| 112 | IL2-120 fused to IgG1 Fc LALAPG |
| 113 | R38Q/D84V mutein fused to IgG1 Fc LALAPG |
| 114 | IL2-116 fused to IgG1 Fc LALAPG |
| 115 | IL2-088 fused to IgG1 Fc LALAPG |
| 116 | IL2-097 fused to IgG1 Fc LALAPG |
| 117 | R38N/H16L mutein fused to IgG1 Fc LALAPG |
| 118 | IL2-098 fused to IgG1 Fc LALAPG |
| 119 | IL2-100 fused to IgG1 Fc LALAPG |
| 120 | IL2-090 fused to IgG1 Fc LALAPG |
| 121 | IL2-092 fused to IgG1 Fc LALAPG |
| 122 | IL2-110 fused to IgG1 Fc LALAPG |
| 123 | IL2-Inactive fused to IgG1 Fc LALAPG |
| 124 | IL2-99 fused to IgG1 Fc LALAPG |
| 125 | IL2-101 fused to IgG1 Fc LALAPG |
| 126 | IL2-102 fused to IgG1 Fc LALAPG |
| 127 | IL2-103 fused to IgG1 Fc LALAPG |
| 128 | IL2-104 fused to IgG1 Fc LALAPG |
| 129 | IL2-114 fused to IgG1 Fc LALAPG |
| 130 | IL2-117 fused to IgG1 Fc LALAPG |
| 131 | IL2-108 fused to IgG1 Fc LALAPG |
| | Exemplary IL-2-Fc Fusion Proteins (IgG1 Fc N297G Mut215) |
| 132 | IL2 C125S fused to IgG1 Fc N297G Mut215 |
| 133 | Stabilized IL-2 fused to IgG1 Fc N297G Mut215 |
| 134 | IL2-037 fused to IgG1 Fc N297G Mut215 |
| 135 | IL2-062 fused to IgG1 Fc N297G Mut215 |

TABLE 9-continued

| | |
|---|---|
| 136 | IL2-118 fused to IgG1 Fc N297G Mut215 |
| 137 | IL2-035 fused to IgG1 Fc N297G Mut215 |
| 138 | IL2-073 fused to IgG1 Fc N297G Mut215 |
| 139 | IL2-077 fused to IgG1 Fc N297G Mut215 |
| 140 | IL2-043 fused to IgG1 Fc N297G Mut215 |
| 141 | IL2-036 fused to IgG1 Fc N297G Mut215 |
| 142 | IL2-068 fused to IgG1 Fc N297G Mut215 |
| 143 | IL2-106 fused to IgG1 Fc N297G Mut215 |
| 144 | IL2-107 fused to IgG1 Fc N297G Mut215 |
| 145 | IL2-119 fused to IgG1 Fc N297G Mut215 |
| 146 | K35E/D84V mutein fused to IgG1 Fc N297G Mut215 |
| 147 | IL2-115 fused to IgG1 Fc N297G Mut215 |
| 148 | IL2-109 fused to IgG1 Fc N297G Mut215 |
| 149 | IL2-113 fused to IgG1 Fc N297G Mut215 |
| 150 | IL2-120 fused to IgG1 Fc N297G Mut215 |
| 151 | R38Q/D84V mutein fused to IgG1 Fc N297G Mut215 |
| 152 | IL2-116 fused to IgG1 Fc N297G Mut215 |
| 153 | IL2-088 fused to IgG1 Fc N297G Mut215 |
| 154 | IL2-097 fused to IgG1 Fc N297G Mut215 |
| 155 | R38N/H16L mutein fused to IgG1 Fc N297G Mut215 |
| 156 | IL2-098 fused to IgG1 Fc N297G Mut215 |
| 157 | IL2-100 fused to IgG1 Fc N297G Mut215 |
| 158 | IL2-090 fused to IgG1 Fc N297G Mut215 |
| 159 | IL2-092 fused to IgG1 Fc N297G Mut215 |
| 160 | IL2-110 fused to IgG1 Fc N297G Mut215 |
| 161 | IL2-Inactive fused to IgG1 Fc N297G Mut215 |
| 162 | IL2-99 fused to IgG1 Fc N297G Mut215 |
| 163 | IL2-101 fused to IgG1 Fc N297G Mut215 |
| 164 | IL2-102 fused to IgG1 Fc N297G Mut215 |
| 165 | IL2-103 fused to IgG1 Fc N297G Mut215 |
| 166 | IL2-104 fused to IgG1 Fc N297G Mut215 |
| 167 | IL2-114 fused to IgG1 Fc N297G Mut215 |
| 168 | IL2-117 fused to IgG1 Fc N297G Mut215 |
| 169 | IL2-108 fused to IgG1 Fc N297G Mut215 |
| | Exemplary IL-2-Fc Fusion Proteins (IgG1 Fc LALAPG Mut215) |
| 170 | IL2 C125S fused to IgG1 Fc LALAPG Mut215 |
| 171 | Stabilized IL-2 fused to IgG1 Fc LALAPG Mut215 |
| 172 | IL2-037 fused to IgG1 Fc LALAPG Mut215 |
| 173 | IL2-062 fused to IgG1 Fc LALAPG Mut215 |
| 174 | IL2-118 fused to IgG1 Fc LALAPG Mut215 |
| 175 | IL2-035 fused to IgG1 Fc LALAPG Mut215 |
| 176 | IL2-073 fused to IgG1 Fc LALAPG Mut215 |
| 177 | IL2-077 fused to IgG1 Fc LALAPG Mut215 |
| 178 | IL2-043 fused to IgG1 Fc LALAPG Mut215 |
| 179 | IL2-036 fused to IgG1 Fc LALAPG Mut215 |
| 180 | IL2-068 fused to IgG1 Fc LALAPG Mut215 |
| 181 | IL2-106 fused to IgG1 Fc LALAPG Mut215 |
| 182 | IL2-107 fused to IgG1 Fc LALAPG Mut215 |
| 183 | IL2-119 fused to IgG1 Fc LALAPG Mut215 |
| 184 | K35E/D84V mutein fused to IgG1 Fc LALAPG Mut215 |
| 185 | IL2-115 fused to IgG1 Fc LALAPG Mut215 |
| 186 | IL2-109 fused to IgG1 Fc LALAPG Mut215 |
| 187 | IL2-113 fused to IgG1 Fc LALAPG Mut215 |
| 188 | IL2-120 fused to IgG1 Fc LALAPG Mut215 |
| 189 | R38Q/D84V mutein fused to IgG1 Fc LALAPG Mut215 |
| 190 | IL2-116 fused to IgG1 Fc LALAPG Mut215 |
| 191 | IL2-088 fused to IgG1 Fc LALAPG Mut215 |
| 192 | IL2-097 fused to IgG1 Fc LALAPG Mut215 |
| 193 | R38N/H16L mutein fused to IgG1 Fc LALAPG Mut215 |
| 194 | IL2-098 fused to IgG1 Fc LALAPG Mut215 |
| 195 | IL2-100 fused to IgG1 Fc LALAPG Mut215 |
| 196 | IL2-090 fused to IgG1 Fc LALAPG Mut215 |
| 197 | IL2-092 fused to IgG1 Fc LALAPG Mut215 |
| 198 | IL2-110 fused to IgG1 Fc LALAPG Mut215 |
| 199 | IL2-Inactive fused to IgG1 Fc LALAPG Mut215 |
| 200 | IL2-99 fused to IgG1 Fc LALAPG Mut215 |
| 201 | IL2-101 fused to IgG1 Fc LALAPG Mut215 |
| 202 | IL2-102 fused to IgG1 Fc LALAPG Mut215 |
| 203 | IL2-103 fused to IgG1 Fc LALAPG Mut215 |
| 204 | IL2-104 fused to IgG1 Fc LALAPG Mut215 |
| 205 | IL2-114 fused to IgG1 Fc LALAPG Mut215 |
| 206 | IL2-117 fused to IgG1 Fc LALAPG Mut215 |
| 207 | IL2-108 fused to IgG1 Fc LALAPG Mut215 |
| | Exemplary IL-2-Fc Fusion Proteins (IgG4 Fc S228P) |
| 208 | IL2 C125S fused to IgG4 Fc S228P |
| 209 | Stabilized IL-2 fused to IgG4 Fc S228P |
| 210 | IL2-037 fused to IgG4 Fc S228P |
| 211 | IL2-062 fused to IgG4 Fc S228P |

TABLE 9-continued

| | |
|---|---|
| 212 | IL2-118 fused to IgG4 Fc S228P |
| 213 | IL2-035 fused to IgG4 Fc S228P |
| 214 | IL2-073 fused to IgG4 Fc S228P |
| 215 | IL2-077 fused to IgG4 Fc S228P |
| 216 | IL2-043 fused to IgG4 Fc S228P |
| 217 | IL2-036 fused to IgG4 Fc S228P |
| 218 | IL2-068 fused to IgG4 Fc S228P |
| 219 | IL2-106 fused to IgG4 Fc S228P |
| 220 | IL2-107 fused to IgG4 Fc S228P |
| 221 | IL2-119 fused to IgG4 Fc S228P |
| 222 | K35E/D84V mutein fused to IgG4 Fc S228P |
| 223 | IL2-115 fused to IgG4 Fc S228P |
| 224 | IL2-109 fused to IgG4 Fc S228P |
| 225 | IL2-113 fused to IgG4 Fc S228P |
| 226 | IL2-120 fused to IgG4 Fc S228P |
| 227 | R38Q/D84V mutein fused to IgG4 Fc S228P |
| 228 | IL2-116 fused to IgG4 Fc S228P |
| 229 | IL2-088 fused to IgG4 Fc S228P |
| 230 | IL2-097 fused to IgG4 Fc S228P |
| 231 | R38N/H16L mutein fused to IgG4 Fc S228P |
| 232 | IL2-098 fused to IgG4 Fc S228P |
| 233 | IL2-100 fused to IgG4 Fc S228P |
| 234 | IL2-090 fused to IgG4 Fc S228P |
| 235 | IL2-092 fused to IgG4 Fc S228P |
| 236 | IL2-110 fused to IgG4 Fc S228P |
| 237 | IL2-Inactive fused to IgG4 Fc S228P |
| 238 | IL2-99 fused to IgG4 Fc S228P |
| 239 | IL2-101 fused to IgG4 Fc S228P |
| 240 | IL2-102 fused to IgG4 Fc S228P |
| 241 | IL2-103 fused to IgG4 Fc S228P |
| 242 | IL2-104 fused to IgG4 Fc S228P |
| 243 | IL2-114 fused to IgG4 Fc S228P |
| 244 | IL2-117 fused to IgG4 Fc S228P |
| 245 | IL2-108 fused to IgG4 Fc S228P |
| | Exemplary IL-2-Fc Fusion Proteins (IgG4 Fc S228P/R409K) |
| 246 | IL2 C125S fused to IgG4 Fc S228P/R409K |
| 247 | Stabilized IL-2 fused to IgG4 Fc S228P/R409K |
| 248 | IL2-037 fused to IgG4 Fc S228P/R409K |
| 249 | IL2-062 fused to IgG4 Fc S228P/R409K |
| 250 | IL2-118 fused to IgG4 Fc S228P/R409K |
| 251 | IL2-035 fused to IgG4 Fc S228P/R409K |
| 252 | IL2-073 fused to IgG4 Fc S228P/R409K |
| 253 | IL2-077 fused to IgG4 Fc S228P/R409K |
| 254 | IL2-043 fused to IgG4 Fc S228P/R409K |
| 255 | IL2-036 fused to IgG4 Fc S228P/R409K |
| 256 | IL2-068 fused to IgG4 Fc S228P/R409K |
| 257 | IL2-106 fused to IgG4 Fc S228P/R409K |
| 258 | IL2-107 fused to IgG4 Fc S228P/R409K |
| 259 | IL2-119 fused to IgG4 Fc S228P/R409K |
| 260 | K35E/D84V mutein fused to IgG4 Fc S228P/R409K |
| 261 | IL2-115 fused to IgG4 Fc S228P/R409K |
| 262 | IL2-109 fused to IgG4 Fc S228P/R409K |
| 263 | IL2-113 fused to IgG4 Fc S228P/R409K |
| 264 | IL2-120 fused to IgG4 Fc S228P/R409K |
| 265 | R38Q/D84V mutein fused to IgG4 Fc S228P/R409K |
| 266 | IL2-116 fused to IgG4 Fc S228P/R409K |
| 267 | IL2-088 fused to IgG4 Fc S228P/R409K |
| 268 | IL2-097 fused to IgG4 Fc S228P/R409K |
| 269 | R38N/H16L mutein fused to IgG4 Fc S228P/R409K |
| 270 | IL2-098 fused to IgG4 Fc S228P/R409K |
| 271 | IL2-100 fused to IgG4 Fc S228P/R409K |
| 272 | IL2-090 fused to IgG4 Fc S228P/R409K |
| 273 | IL2-092 fused to IgG4 Fc S228P/R409K |
| 274 | IL2-110 fused to IgG4 Fc S228P/R409K |
| 275 | IL2-Inactive fused to IgG4 Fc S228P/R409K |
| 276 | IL2-99 fused to IgG4 Fc S228P/R409K |
| 277 | IL2-101 fused to IgG4 Fc S228P/R409K |
| 278 | IL2-102 fused to IgG4 Fc S228P/R409K |
| 279 | IL2-103 fused to IgG4 Fc S228P/R409K |
| 280 | IL2-104 fused to IgG4 Fc S228P/R409K |
| 281 | IL2-114 fused to IgG4 Fc S228P/R409K |
| 282 | IL2-117 fused to IgG4 Fc S228P/R409K |
| 283 | IL2-108 fused to IgG4 Fc S228P/R409K |
| | Exemplary IL-2-Fc Fusion Proteins (IgG4 Fc S228P Mut215) |
| 284 | IL2 C125S fused to IgG4 Fc S228P Mut215 |
| 285 | Stabilized IL-2 fused to IgG4 Fc S228P Mut215 |
| 286 | IL2-037 fused to IgG4 Fc S228P Mut215 |
| 287 | IL2-062 fused to IgG4 Fc S228P Mut215 |

TABLE 9-continued

| | |
|---|---|
| 288 | IL2-118 fused to IgG4 Fc S228P Mut215 |
| 289 | IL2-035 fused to IgG4 Fc S228P Mut215 |
| 290 | IL2-073 fused to IgG4 Fc S228P Mut215 |
| 291 | IL2-077 fused to IgG4 Fc S228P Mut215 |
| 292 | IL2-043 fused to IgG4 Fc S228P Mut215 |
| 293 | IL2-036 fused to IgG4 Fc S228P Mut215 |
| 294 | IL2-068 fused to IgG4 Fc S228P Mut215 |
| 295 | IL2-106 fused to IgG4 Fc S228P Mut215 |
| 296 | IL2-107 fused to IgG4 Fc S228P Mut215 |
| 297 | IL2-119 fused to IgG4 Fc S228P Mut215 |
| 298 | K35E/D84V mutein fused to IgG4 Fc S228P Mut215 |
| 299 | IL2-115 fused to IgG4 Fc S228P Mut215 |
| 300 | IL2-109 fused to IgG4 Fc S228P Mut215 |
| 301 | IL2-113 fused to IgG4 Fc S228P Mut215 |
| 302 | IL2-120 fused to IgG4 Fc S228P Mut215 |
| 303 | R38Q/D84V mutein fused to IgG4 Fc S228P Mut215 |
| 304 | IL2-116 fused to IgG4 Fc S228P Mut215 |
| 305 | IL2-088 fused to IgG4 Fc S228P Mut215 |
| 306 | IL2-097 fused to IgG4 Fc S228P Mut215 |
| 307 | R38N/H16L mutein fused to IgG4 Fc S228P Mut215 |
| 308 | IL2-098 fused to IgG4 Fc S228P Mut215 |
| 309 | IL2-100 fused to IgG4 Fc S228P Mut215 |
| 310 | IL2-090 fused to IgG4 Fc S228P Mut215 |
| 311 | IL2-092 fused to IgG4 Fc S228P Mut215 |
| 312 | IL2-110 fused to IgG4 Fc S228P Mut215 |
| 313 | IL2-Inactive fused to IgG4 Fc S228P Mut215 |
| 314 | IL2-99 fused to IgG4 Fc S228P Mut215 |
| 315 | IL2-101 fused to IgG4 Fc S228P Mut215 |
| 316 | IL2-102 fused to IgG4 Fc S228P Mut215 |
| 317 | IL2-103 fused to IgG4 Fc S228P Mut215 |
| 318 | IL2-104 fused to IgG4 Fc S228P Mut215 |
| 319 | IL2-114 fused to IgG4 Fc S228P Mut215 |
| 320 | IL2-117 fused to IgG4 Fc S228P Mut215 |
| 321 | IL2-108 fused to IgG4 Fc S228P Mut215 |
| | Exemplary IL-2-Fc Fusion Proteins (IgG4 Fc S228P/R409K Mut215) |
| 322 | IL2 C125S fused to IgG4 Fc S228P/R409K Mut215 |
| 323 | Stabilized IL-2 fused to IgG4 Fc S228P/R409K Mut215 |
| 324 | IL2-037 fused to IgG4 Fc S228P/R409K Mut215 |
| 325 | IL2-062 fused to IgG4 Fc S228P/R409K Mut215 |
| 326 | IL2-118 fused to IgG4 Fc S228P/R409K Mut215 |
| 327 | IL2-035 fused to IgG4 Fc S228P/R409K Mut215 |
| 328 | IL2-073 fused to IgG4 Fc S228P/R409K Mut215 |
| 329 | IL2-077 fused to IgG4 Fc S228P/R409K Mut215 |
| 330 | IL2-043 fused to IgG4 Fc S228P/R409K Mut215 |
| 331 | IL2-036 fused to IgG4 Fc S228P/R409K Mut215 |
| 332 | IL2-068 fused to IgG4 Fc S228P/R409K Mut215 |
| 333 | IL2-106 fused to IgG4 Fc S228P/R409K Mut215 |
| 334 | IL2-107 fused to IgG4 Fc S228P/R409K Mut215 |
| 335 | IL2-119 fused to IgG4 Fc S228P/R409K Mut215 |
| 336 | K35E/D84V mutein fused to IgG4 Fc S228P/R409K Mut215 |
| 337 | IL2-115 fused to IgG4 Fc S228P/R409K Mut215 |
| 338 | IL2-109 fused to IgG4 Fc S228P/R409K Mut215 |
| 339 | IL2-113 fused to IgG4 Fc S228P/R409K Mut215 |
| 340 | IL2-120 fused to IgG4 Fc S228P/R409K Mut215 |
| 341 | R38Q/D84V mutein fused to IgG4 Fc S228P/R409K Mut215 |
| 342 | IL2-116 fused to IgG4 Fc S228P/R409K Mut215 |
| 343 | IL2-088 fused to IgG4 Fc S228P/R409K Mut215 |
| 344 | IL2-097 fused to IgG4 Fc S228P/R409K Mut215 |
| 345 | R38N/H16L mutein fused to IgG4 Fc S228P/R409K Mut215 |
| 346 | IL2-098 fused to IgG4 Fc S228P/R409K Mut215 |
| 347 | IL2-100 fused to IgG4 Fc S228P/R409K Mut215 |
| 348 | IL2-090 fused to IgG4 Fc S228P/R409K Mut215 |
| 349 | IL2-092 fused to IgG4 Fc S228P/R409K Mut215 |
| 350 | IL2-110 fused to IgG4 Fc S228P/R409K Mut215 |
| 351 | IL2-Inactive fused to IgG4 Fc S228P/R409K Mut215 |
| 352 | IL2-99 fused to IgG4 Fc S228P/R409K Mut215 |
| 353 | IL2-101 fused to IgG4 Fc S228P/R409K Mut215 |
| 354 | IL2-102 fused to IgG4 Fc S228P/R409K Mut215 |
| 355 | IL2-103 fused to IgG4 Fc S228P/R409K Mut215 |
| 356 | IL2-104 fused to IgG4 Fc S228P/R409K Mut215 |
| 357 | IL2-114 fused to IgG4 Fc S228P/R409K Mut215 |
| 358 | IL2-117 fused to IgG4 Fc S228P/R409K Mut215 |
| 359 | IL2-108 fused to IgG4 Fc S228P/R409K Mut215 |
| 360 | Wild type (WT) Human IL-2 (Uniprot P60568); signal peptide underlined |
| 1031 | Wild type (WT) Human IL-2 (Uniprot P60568); signal peptide not included |

TABLE 10

Description of Exemplary Nucleotide Sequences

| SEQ ID NO | Description | Substitutions |
|---|---|---|
| | Exemplary IL-2 Variants (Muteins) | |
| 361 | IL2 C125S | C125S |
| 362 | Stabilized IL-2 | V69A/Q74P/C125S |
| 363 | IL2-037 | H16D/V69A/Q74P/C125S |
| 364 | IL2-062 | H16N/V69A/Q74P/C125S |
| 365 | IL2-118 | H16L/V69A/Q74P/C125S |
| 366 | IL2-035 | I28T/V69A/Q74P/C125S |
| 367 | IL2-073 | V69A/Q74P/D84V/C125S |
| 368 | IL2-077 | V69A/Q74P/S87R/C125S |
| 369 | IL2-043 | V69A/Q74P/N88L/C125S |
| 370 | IL2-036 | V69A/Q74P/N88S/C125S |
| 371 | IL2-068 | V69A/Q74P/I92S/C125S |
| 372 | IL2-106 | K35E/V69A/Q74P/C125S |
| 373 | IL2-107 | K35E/H16N/V69A/Q74P/C125S |
| 374 | IL2-119 | K35E/H16L/V69A/Q74P/C125S |
| 375 | K35E/D84V mutein | K35E/D84V/V69A/Q74P/C125S |
| 376 | IL2-115 | K35E/I92S/V69A/Q74P/C125S |
| 377 | IL2-109 | R38Q/V69A/Q74P/C125S |
| 378 | IL2-113 | R38Q/H16N/V69A/Q74P/C125S |
| 379 | IL2-120 | R38Q/H16L/V69A/Q74P/C125S |
| 380 | R38Q/D84V mutein | R38Q/D84V/V69A/Q74P/C125S |
| 381 | IL2-116 | R38Q/I92S/Q74P/C125S |
| 382 | IL2-088 | R38N/V69A/Q74P/C125S |
| 383 | IL2-097 | R38N/H16N/V69A/Q74P/C125S |
| 384 | R38N/H16L mutein | R38N/H16L/V69A/Q74P/C125S |
| 385 | IL2-098 | R38N/D84V/V69A/Q74P/C125S |
| 386 | IL2-100 | R38N/I92S/Q74P/C125S |
| 387 | IL2-090 | R38E/V69A/Q74P/C125S |
| 388 | IL2-092 | F42K/V69A/Q74P/C125S |
| 389 | IL2-110 | F42Q/V69A/Q74P/C125S |
| 390 | IL2-Inactive | F42A/Y45A/L72G/N88D/V69A/Q74P/C125S |
| 391 | IL2-99 | R38N/S87R/V69A/Q74P/C125S |
| 392 | IL2-101 | R38E/H16N/V69A/Q74P/C125S |
| 393 | IL2-102 | R38E/D84V/V69A/Q74P/C125S |
| 394 | IL2-103 | R38E/S87R/V69A/Q74P/C125S |
| 395 | IL2-104 | R38E/I92S/V69A/Q74P/C125S |
| 396 | IL2-114 | F42Q/H16N/V69A/Q74P/C125S |
| 397 | IL2-117 | F42Q/I92S/V69A/Q74P/C125S |
| 398 | IL2-108 | K35E/R38N/H16N/V69A/Q74P/C125S |
| 1010 | IL2-124 | T3A/H16N/V69A/Q74P/C125S |
| 1011 | IL2-127 | T3A/H16L/V69A/Q74P/I92S/C125S |
| 1012 | IL2-130 | T3A/V69A/Q74P/C125S |
| | Exemplary Fc Regions | |
| 399 | IgG1 Fc | |
| 400 | IgG1 Fc N297G | N297G |
| 401 | IgG1 Fc LALAPG | L234A/L235A/P329G |
| 402 | IgG1 Fc N297G Mut215 | N297G/T307Q/Q311V/A378V |
| 403 | IgG1 Fc LALAPG Mut215 | L234A/L235A/P329G/T307Q/Q311V/A378V |
| 404 | IgG4 Fc S228P | S228P |
| 405 | IgG4 Fc S228P/R409K | S228P/R409K |
| 406 | IgG4 Fc S228P Mut215 | S228P/T307Q/Q311V/A378V |
| 407 | IgG4 Fc S228P/R409K Mut215 | S228P/R409K/T307Q/Q311V/A378V |
| 1013 | IgG1 Fc N297G m3 allotype | N297G |

Exemplary Linkers

| SEQ ID NO | Description |
|---|---|
| 408 | (G4S)4 linker (SEQ ID NO: 48) |
| 409 | Linker v1 |
| 410 | Linker v2 |
| 411 | Linker v3 |
| 412 | Linker v4 |
| 413 | Linker v5 |

TABLE 10-continued

| | |
|---|---|
| 414 | Linker v6 |
| 415 | Linker v7 |
| | Exemplary IL-2-Fc Fusion Proteins (IgG1 Fc N297G) |
| 416 | IL2 C125S fused to IgG1 Fc N297G |
| 417 | Stabilized IL-2 fused to IgG1 Fc N297G |
| 418 | IL2-037 fused to IgG1 Fc N297G |
| 419 | IL2-062 fused to IgG1 Fc N297G |
| 420 | IL2-118 fused to IgG1 Fc N297G |
| 421 | IL2-035 fused to IgG1 Fc N297G |
| 422 | IL2-073 fused to IgG1 Fc N297G |
| 423 | IL2-077 fused to IgG1 Fc N297G |
| 424 | IL2-043 fused to IgG1 Fc N297G |
| 425 | IL2-036 fused to IgG1 Fc N297G |
| 426 | IL2-068 fused to IgG1 Fc N297G |
| 427 | IL2-106 fused to IgG1 Fc N297G |
| 428 | IL2-107 fused to IgG1 Fc N297G |
| 429 | IL2-119 fused to IgG1 Fc N297G |
| 430 | K35E/D84V mutein fused to IgG1 Fc N297G |
| 431 | IL2-115 fused to IgG1 Fc N297G |
| 432 | IL2-109 fused to IgG1 Fc N297G |
| 433 | IL2-113 fused to IgG1 Fc N297G |
| 434 | IL2-120 fused to IgG1 Fc N297G |
| 435 | R38Q/D84V mutein fused to IgG1 Fc N297G |
| 436 | IL2-116 fused to IgG1 Fc N297G |
| 437 | IL2-088 fused to IgG1 Fc N297G |
| 438 | IL2-097 fused to IgG1 Fc N297G |
| 439 | R38N/H16L mutein fused to IgG1 Fc N297G |
| 440 | IL2-098 fused to IgG1 Fc N297G |
| 441 | IL2-100 fused to IgG1 Fc N297G |
| 442 | IL2-090 fused to IgG1 Fc N297G |
| 443 | IL2-092 fused to IgG1 Fc N297G |
| 444 | IL2-110 fused to IgG1 Fc N297G |
| 445 | IL2-Inactive fused to IgG1 Fc N297G |
| 446 | IL2-99 fused to IgG1 Fc N297G |
| 447 | IL2-101 fused to IgG1 Fc N297G |
| 448 | IL2-102 fused to IgG1 Fc N297G |
| 449 | IL2-103 fused to IgG1 Fc N297G |
| 450 | IL2-104 fused to IgG1 Fc N297G |
| 451 | IL2-114 fused to IgG1 Fc N297G |
| 452 | IL2-117 fused to IgG1 Fc N297G |
| 453 | IL2-108 fused to IgG1 Fc N297G |
| 1014 | IL2-124 fused to IgG1 Fc N297G allotype m3 |
| 1015 | IL2-127 fused to IgG1 Fc N297G allotype m3 |
| 1016 | IL2-130 fused to IgG1 Fc N297G allotype m3 |
| 1017 | IL2-062 fused to IgG1 Fc N297G allotype m3 |
| 1018 | IL2-118 fused to IgG1 Fc N297G allotype m3 |
| 1019 | IL2-068 fused to IgG1 Fc N297G allotype m3 |
| | Exemplary IL-2-Fc Fusion Proteins (IgG1 Fc LALAPG) |
| 454 | IL2 C125S fused to IgG1 Fc LALAPG |
| 455 | Stabilized IL-2 fused to IgG1 Fc LALAPG |
| 456 | IL2-037 fused to IgG1 Fc LALAPG |
| 457 | IL2-062 fused to IgG1 Fc LALAPG |
| 458 | IL2-118 fused to IgG1 Fc LALAPG |
| 459 | IL2-035 fused to IgG1 Fc LALAPG |
| 460 | IL2-073 fused to IgG1 Fc LALAPG |
| 461 | IL2-077 fused to IgG1 Fc LALAPG |
| 462 | IL2-043 fused to IgG1 Fc LALAPG |
| 463 | IL2-036 fused to IgG1 Fc LALAPG |
| 464 | IL2-068 fused to IgG1 Fc LALAPG |
| 465 | IL2-106 fused to IgG1 Fc LALAPG |
| 466 | IL2-107 fused to IgG1 Fc LALAPG |
| 467 | IL2-119 fused to IgG1 Fc LALAPG |
| 468 | K35E/D84V mutein fused to IgG1 Fc LALAPG |
| 469 | IL2-115 fused to IgG1 Fc LALAPG |
| 470 | IL2-109 fused to IgG1 Fc LALAPG |
| 471 | IL2-113 fused to IgG1 Fc LALAPG |
| 472 | IL2-120 fused to IgG1 Fc LALAPG |
| 473 | R38Q/D84V mutein fused to IgG1 Fc LALAPG |
| 474 | IL2-116 fused to IgG1 Fc LALAPG |
| 475 | IL2-088 fused to IgG1 Fc LALAPG |
| 476 | IL2-097 fused to IgG1 Fc LALAPG |
| 477 | R38N/H16L mutein fused to IgG1 Fc LALAPG |
| 478 | IL2-098 fused to IgG1 Fc LALAPG |
| 479 | IL2-100 fused to IgG1 Fc LALAPG |
| 480 | IL2-090 fused to IgG1 Fc LALAPG |
| 481 | IL2-092 fused to IgG1 Fc LALAPG |
| 482 | IL2-110 fused to IgG1 Fc LALAPG |
| 483 | IL2-Inactive fused to IgG1 Fc LALAPG |

TABLE 10-continued

| 484 | IL2-99 fused to IgG1 Fc LALAPG |
|---|---|
| 485 | IL2-101 fused to IgG1 Fc LALAPG |
| 486 | IL2-102 fused to IgG1 Fc LALAPG |
| 487 | IL2-103 fused to IgG1 Fc LALAPG |
| 488 | IL2-104 fused to IgG1 Fc LALAPG |
| 489 | IL2-114 fused to IgG1 Fc LALAPG |
| 490 | IL2-117 fused to IgG1 Fc LALAPG |
| 491 | IL2-108 fused to IgG1 Fc LALAPG |
| | Exemplary IL-2-Fc Fusion Proteins (IgG1 Fc N297G Mut215) |
| 492 | IL2 C125S fused to IgG1 Fc N297G Mut215 |
| 493 | Stabilized IL-2 fused to IgG1 Fc N297G Mut215 |
| 494 | IL2-037 fused to IgG1 Fc N297G Mut215 |
| 495 | IL2-062 fused to IgG1 Fc N297G Mut215 |
| 496 | IL2-118 fused to IgG1 Fc N297G Mut215 |
| 497 | IL2-035 fused to IgG1 Fc N297G Mut215 |
| 498 | IL2-073 fused to IgG1 Fc N297G Mut215 |
| 499 | IL2-077 fused to IgG1 Fc N297G Mut215 |
| 500 | IL2-043 fused to IgG1 Fc N297G Mut215 |
| 501 | IL2-036 fused to IgG1 Fc N297G Mut215 |
| 502 | IL2-068 fused to IgG1 Fc N297G Mut215 |
| 503 | IL2-106 fused to IgG1 Fc N297G Mut215 |
| 504 | IL2-107 fused to IgG1 Fc N297G Mut215 |
| 505 | IL2-119 fused to IgG1 Fc N297G Mut215 |
| 506 | K35E/D84V mutein fused to IgG1 Fc N297G Mut215 |
| 507 | IL2-115 fused to IgG1 Fc N297G Mut215 |
| 508 | IL2-109 fused to IgG1 Fc N297G Mut215 |
| 509 | IL2-113 fused to IgG1 Fc N297G Mut215 |
| 510 | IL2-120 fused to IgG1 Fc N297G Mut215 |
| 511 | R38Q/D84V mutein fused to IgG1 Fc N297G Mut215 |
| 512 | IL2-116 fused to IgG1 Fc N297G Mut215 |
| 513 | IL2-088 fused to IgG1 Fc N297G Mut215 |
| 514 | IL2-097 fused to IgG1 Fc N297G Mut215 |
| 515 | R38N/H16L mutein fused to IgG1 Fc N297G Mut215 |
| 516 | IL2-098 fused to IgG1 Fc N297G Mut215 |
| 517 | IL2-100 fused to IgG1 Fc N297G Mut215 |
| 518 | IL2-090 fused to IgG1 Fc N297G Mut215 |
| 519 | IL2-092 fused to IgG1 Fc N297G Mut215 |
| 520 | IL2-110 fused to IgG1 Fc N297G Mut215 |
| 521 | IL2-Inactive fused to IgG1 Fc N297G Mut215 |
| 522 | IL2-99 fused to IgG1 Fc N297G Mut215 |
| 523 | IL2-101 fused to IgG1 Fc N297G Mut215 |
| 524 | IL2-102 fused to IgG1 Fc N297G Mut215 |
| 525 | IL2-103 fused to IgG1 Fc N297G Mut215 |
| 526 | IL2-104 fused to IgG1 Fc N297G Mut215 |
| 527 | IL2-114 fused to IgG1 Fc N297G Mut215 |
| 528 | IL2-117 fused to IgG1 Fc N297G Mut215 |
| 529 | IL2-108 fused to IgG1 Fc N297G Mut215 |
| | Exemplary IL-2-Fc Fusion Proteins (IgG1 Fc LALAPG Mut215) |
| 530 | IL2 C125S fused to IgG1 Fc LALAPG Mut215 |
| 531 | Stabilized IL-2 fused to IgG1 Fc LALAPG Mut215 |
| 532 | IL2-037 fused to IgG1 Fc LALAPG Mut215 |
| 533 | IL2-062 fused to IgG1 Fc LALAPG Mut215 |
| 534 | IL2-118 fused to IgG1 Fc LALAPG Mut215 |
| 535 | IL2-035 fused to IgG1 Fc LALAPG Mut215 |
| 536 | IL2-073 fused to IgG1 Fc LALAPG Mut215 |
| 537 | IL2-077 fused to IgG1 Fc LALAPG Mut215 |
| 538 | IL2-043 fused to IgG1 Fc LALAPG Mut215 |
| 539 | IL2-036 fused to IgG1 Fc LALAPG Mut215 |
| 540 | IL2-068 fused to IgG1 Fc LALAPG Mut215 |
| 541 | IL2-106 fused to IgG1 Fc LALAPG Mut215 |
| 542 | IL2-107 fused to IgG1 Fc LALAPG Mut215 |
| 543 | IL2-119 fused to IgG1 Fc LALAPG Mut215 |
| 544 | K35E/D84V mutein fused to IgG1 Fc LALAPG Mut215 |
| 545 | IL2-115 fused to IgG1 Fc LALAPG Mut215 |
| 546 | IL2-109 fused to IgG1 Fc LALAPG Mut215 |
| 547 | IL2-113 fused to IgG1 Fc LALAPG Mut215 |
| 548 | IL2-120 fused to IgG1 Fc LALAPG Mut215 |
| 549 | R38Q/D84V mutein fused to IgG1 Fc LALAPG Mut215 |
| 550 | IL2-116 fused to IgG1 Fc LALAPG Mut215 |
| 551 | IL2-088 fused to IgG1 Fc LALAPG Mut215 |
| 552 | IL2-097 fused to IgG1 Fc LALAPG Mut215 |
| 553 | R38N/H16L mutein fused to IgG1 Fc LALAPG Mut215 |
| 554 | IL2-098 fused to IgG1 Fc LALAPG Mut215 |
| 555 | IL2-100 fused to IgG1 Fc LALAPG Mut215 |
| 556 | IL2-090 fused to IgG1 Fc LALAPG Mut215 |
| 557 | IL2-092 fused to IgG1 Fc LALAPG Mut215 |
| 558 | IL2-110 fused to IgG1 Fc LALAPG Mut215 |
| 559 | IL2-Inactive fused to IgG1 Fc LALAPG Mut215 |

TABLE 10-continued

| 560 | IL2-99 fused to IgG1 Fc LALAPG Mut215 |
|---|---|
| 561 | IL2-101 fused to IgG1 Fc LALAPG Mut215 |
| 562 | IL2-102 fused to IgG1 Fc LALAPG Mut215 |
| 563 | IL2-103 fused to IgG1 Fc LALAPG Mut215 |
| 564 | IL2-104 fused to IgG1 Fc LALAPG Mut215 |
| 565 | IL2-114 fused to IgG1 Fc LALAPG Mut215 |
| 566 | IL2-117 fused to IgG1 Fc LALAPG Mut215 |
| 567 | IL2-108 fused to IgG1 Fc LALAPG Mut215 |
| | Exemplary IL-2-Fc Fusion Proteins (IgG4 Fc S228P) |
| 568 | IL2 C125S fused to IgG4 Fc S228P |
| 569 | Stabilized IL-2 fused to IgG4 Fc S228P |
| 570 | IL2-037 fused to IgG4 Fc S228P |
| 571 | IL2-062 fused to IgG4 Fc S228P |
| 572 | IL2-118 fused to IgG4 Fc S228P |
| 573 | IL2-035 fused to IgG4 Fc S228P |
| 574 | IL2-073 fused to IgG4 Fc S228P |
| 575 | IL2-077 fused to IgG4 Fc S228P |
| 576 | IL2-043 fused to IgG4 Fc S228P |
| 577 | IL2-036 fused to IgG4 Fc S228P |
| 578 | IL2-068 fused to IgG4 Fc S228P |
| 579 | IL2-106 fused to IgG4 Fc S228P |
| 580 | IL2-107 fused to IgG4 Fc S228P |
| 581 | IL2-119 fused to IgG4 Fc S228P |
| 582 | K35E/D84V mutein fused to IgG4 Fc S228P |
| 583 | IL2-115 fused to IgG4 Fc S228P |
| 584 | IL2-109 fused to IgG4 Fc S228P |
| 585 | IL2-113 fused to IgG4 Fc S228P |
| 586 | IL2-120 fused to IgG4 Fc S228P |
| 587 | R38Q/D84V mutein fused to IgG4 Fc S228P |
| 588 | IL2-116 fused to IgG4 Fc S228P |
| 589 | IL2-088 fused to IgG4 Fc S228P |
| 590 | IL2-097 fused to IgG4 Fc S228P |
| 591 | R38N/H16L mutein fused to IgG4 Fc S228P |
| 592 | IL2-098 fused to IgG4 Fc S228P |
| 593 | IL2-100 fused to IgG4 Fc S228P |
| 594 | IL2-090 fused to IgG4 Fc S228P |
| 595 | IL2-092 fused to IgG4 Fc S228P |
| 596 | IL2-110 fused to IgG4 Fc S228P |
| 597 | IL2-Inactive fused to IgG4 Fc S228P |
| 598 | IL2-99 fused to IgG4 Fc S228P |
| 599 | IL2-101 fused to IgG4 Fc S228P |
| 600 | IL2-102 fused to IgG4 Fc S228P |
| 601 | IL2-103 fused to IgG4 Fc S228P |
| 602 | IL2-104 fused to IgG4 Fc S228P |
| 603 | IL2-114 fused to IgG4 Fc S228P |
| 604 | IL2-117 fused to IgG4 Fc S228P |
| 605 | IL2-108 fused to IgG4 Fc S228P |
| | Exemplary IL-2-Fc Fusion Proteins (IgG4 Fc S228P/R409K) |
| 606 | IL2 C125S fused to IgG4 Fc S228P/R409K |
| 607 | Stabilized IL-2 fused to IgG4 Fc S228P/R409K |
| 608 | IL2-037 fused to IgG4 Fc S228P/R409K |
| 609 | IL2-062 fused to IgG4 Fc S228P/R409K |
| 610 | IL2-118 fused to IgG4 Fc S228P/R409K |
| 611 | IL2-035 fused to IgG4 Fc S228P/R409K |
| 612 | IL2-073 fused to IgG4 Fc S228P/R409K |
| 613 | IL2-077 fused to IgG4 Fc S228P/R409K |
| 614 | IL2-043 fused to IgG4 Fc S228P/R409K |
| 615 | IL2-036 fused to IgG4 Fc S228P/R409K |
| 616 | IL2-068 fused to IgG4 Fc S228P/R409K |
| 617 | IL2-106 fused to IgG4 Fc S228P/R409K |
| 618 | IL2-107 fused to IgG4 Fc S228P/R409K |
| 619 | IL2-119 fused to IgG4 Fc S228P/R409K |
| 620 | K35E/D84V mutein fused to IgG4 Fc S228P/R409K |
| 621 | IL2-115 fused to IgG4 Fc S228P/R409K |
| 622 | IL2-109 fused to IgG4 Fc S228P/R409K |
| 623 | IL2-113 fused to IgG4 Fc S228P/R409K |
| 624 | IL2-120 fused to IgG4 Fc S228P/R409K |
| 625 | R38Q/D84V mutein fused to IgG4 Fc S228P/R409K |
| 626 | IL2-116 fused to IgG4 Fc S228P/R409K |
| 627 | IL2-088 fused to IgG4 Fc S228P/R409K |
| 628 | IL2-097 fused to IgG4 Fc S228P/R409K |
| 629 | R38N/H16L mutein fused to IgG4 Fc S228P/R409K |
| 630 | IL2-098 fused to IgG4 Fc S228P/R409K |
| 631 | IL2-100 fused to IgG4 Fc S228P/R409K |
| 632 | IL2-090 fused to IgG4 Fc S228P/R409K |
| 633 | IL2-092 fused to IgG4 Fc S228P/R409K |
| 634 | IL2-110 fused to IgG4 Fc S228P/R409K |
| 635 | IL2-Inactive fused to IgG4 Fc S228P/R409K |

TABLE 10-continued

| 636 | IL2-99 fused to IgG4 Fc S228P/R409K |
| 637 | IL2-101 fused to IgG4 Fc S228P/R409K |
| 638 | IL2-102 fused to IgG4 Fc S228P/R409K |
| 639 | IL2-103 fused to IgG4 Fc S228P/R409K |
| 640 | IL2-104 fused to IgG4 Fc S228P/R409K |
| 641 | IL2-114 fused to IgG4 Fc S228P/R409K |
| 642 | IL2-117 fused to IgG4 Fc S228P/R409K |
| 643 | IL2-108 fused to IgG4 Fc S228P/R409K |
| | Exemplary IL-2-Fc Fusion Proteins (IgG4 Fc S228P Mut215) |
| 644 | IL2 C125S fused to IgG4 Fc S228P Mut215 |
| 645 | Stabilized IL-2 fused to IgG4 Fc S228P Mut215 |
| 646 | IL2-037 fused to IgG4 Fc S228P Mut215 |
| 647 | IL2-062 fused to IgG4 Fc S228P Mut215 |
| 648 | IL2-118 fused to IgG4 Fc S228P Mut215 |
| 649 | IL2-035 fused to IgG4 Fc S228P Mut215 |
| 650 | IL2-073 fused to IgG4 Fc S228P Mut215 |
| 651 | IL2-077 fused to IgG4 Fc S228P Mut215 |
| 652 | IL2-043 fused to IgG4 Fc S228P Mut215 |
| 653 | IL2-036 fused to IgG4 Fc S228P Mut215 |
| 654 | IL2-068 fused to IgG4 Fc S228P Mut215 |
| 655 | IL2-106 fused to IgG4 Fc S228P Mut215 |
| 656 | IL2-107 fused to IgG4 Fc S228P Mut215 |
| 657 | IL2-119 fused to IgG4 Fc S228P Mut215 |
| 658 | K35E/D84V mutein fused to IgG4 Fc S228P Mut215 |
| 659 | IL2-115 fused to IgG4 Fc S228P Mut215 |
| 660 | IL2-109 fused to IgG4 Fc S228P Mut215 |
| 661 | IL2-113 fused to IgG4 Fc S228P Mut215 |
| 662 | IL2-120 fused to IgG4 Fc S228P Mut215 |
| 663 | R38Q/D84V mutein fused to IgG4 Fc S228P Mut215 |
| 664 | IL2-116 fused to IgG4 Fc S228P Mut215 |
| 665 | IL2-088 fused to IgG4 Fc S228P Mut215 |
| 666 | IL2-097 fused to IgG4 Fc S228P Mut215 |
| 667 | R38N/H16L mutein fused to IgG4 Fc S228P Mut215 |
| 668 | IL2-098 fused to IgG4 Fc S228P Mut215 |
| 669 | IL2-100 fused to IgG4 Fc S228P Mut215 |
| 670 | IL2-090 fused to IgG4 Fc S228P Mut215 |
| 671 | IL2-092 fused to IgG4 Fc S228P Mut215 |
| 672 | IL2-110 fused to IgG4 Fc S228P Mut215 |
| 673 | IL2-Inactive fused to IgG4 Fc S228P Mut215 |
| 674 | IL2-99 fused to IgG4 Fc S228P Mut215 |
| 675 | IL2-101 fused to IgG4 Fc S228P Mut215 |
| 676 | IL2-102 fused to IgG4 Fc S228P Mut215 |
| 677 | IL2-103 fused to IgG4 Fc S228P Mut215 |
| 678 | IL2-104 fused to IgG4 Fc S228P Mut215 |

TABLE 10-continued

| 679 | IL2-114 fused to IgG4 Fc S228P Mut215 |
| 680 | IL2-117 fused to IgG4 Fc S228P Mut215 |
| 681 | IL2-108 fused to IgG4 Fc S228P Mut215 |
| | Exemplary IL-2-Fc Fusion Proteins (IgG4 Fc S228P/R409K Mut215) |
| 682 | IL2 C125S fused to IgG4 Fc S228P/R409K Mut215 |
| 683 | Stabilized IL-2 fused to IgG4 Fc S228P/R409K Mut215 |
| 684 | IL2-037 fused to IgG4 Fc S228P/R409K Mut215 |
| 685 | IL2-062 fused to IgG4 Fc S228P/R409K Mut215 |
| 686 | IL2-118 fused to IgG4 Fc S228P/R409K Mut215 |
| 687 | IL2-035 fused to IgG4 Fc S228P/R409K Mut215 |
| 688 | IL2-073 fused to IgG4 Fc S228P/R409K Mut215 |
| 689 | IL2-077 fused to IgG4 Fc S228P/R409K Mut215 |
| 690 | IL2-043 fused to IgG4 Fc S228P/R409K Mut215 |
| 691 | IL2-036 fused to IgG4 Fc S228P/R409K Mut215 |
| 692 | IL2-068 fused to IgG4 Fc S228P/R409K Mut215 |
| 693 | IL2-106 fused to IgG4 Fc S228P/R409K Mut215 |
| 694 | IL2-107 fused to IgG4 Fc S228P/R409K Mut215 |
| 695 | IL2-119 fused to IgG4 Fc S228P/R409K Mut215 |
| 696 | K35E/D84V mutein fused to IgG4 Fc S228P/R409K Mut215 |
| 697 | IL2-115 fused to IgG4 Fc S228P/R409K Mut215 |
| 698 | IL2-109 fused to IgG4 Fc S228P/R409K Mut215 |
| 699 | IL2-113 fused to IgG4 Fc S228P/R409K Mut215 |
| 700 | IL2-120 fused to IgG4 Fc S228P/R409K Mut215 |
| 701 | R38Q/D84V mutein fused to IgG4 Fc S228P/R409K Mut215 |
| 702 | IL2-116 fused to IgG4 Fc S228P/R409K Mut215 |
| 703 | IL2-088 fused to IgG4 Fc S228P/R409K Mut215 |
| 704 | IL2-097 fused to IgG4 Fc S228P/R409K Mut215 |
| 705 | R38N/H16L mutein fused to IgG4 Fc S228P/R409K Mut215 |
| 706 | IL2-098 fused to IgG4 Fc S228P/R409K Mut215 |
| 707 | IL2-100 fused to IgG4 Fc S228P/R409K Mut215 |
| 708 | IL2-090 fused to IgG4 Fc S228P/R409K Mut215 |
| 709 | IL2-092 fused to IgG4 Fc S228P/R409K Mut215 |
| 710 | IL2-110 fused to IgG4 Fc S228P/R409K Mut215 |
| 711 | IL2-Inactive fused to IgG4 Fc S228P/R409K Mut215 |
| 712 | IL2-99 fused to IgG4 Fc S228P/R409K Mut215 |
| 713 | IL2-101 fused to IgG4 Fc S228P/R409K Mut215 |
| 714 | IL2-102 fused to IgG4 Fc S228P/R409K Mut215 |
| 715 | IL2-103 fused to IgG4 Fc S228P/R409K Mut215 |
| 716 | IL2-104 fused to IgG4 Fc S228P/R409K Mut215 |
| 717 | IL2-114 fused to IgG4 Fc S228P/R409K Mut215 |
| 718 | IL2-117 fused to IgG4 Fc S228P/R409K Mut215 |
| 719 | IL2-108 fused to IgG4 Fc S228P/R409K Mut215 |

SEQUENCE LISTING (1032 sequences)

SEQ ID NO: 1 - protein, 133 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLT

SEQ ID NO: 2 - protein, 133 aa, synthetic construct [sequence omitted]

SEQ ID NO: 3 - protein, 133 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 4 - protein, 133 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 5 - protein, 133 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 6 - protein, 133 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 7 - protein, 133 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 8 - protein, 133 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLT

SEQ ID NO: 9 - protein, 133 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLT

SEQ ID NO: 10 - protein, 133 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLT

SEQ ID NO: 11 - protein, 133 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 12 - protein, 133 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 13 - protein, 133 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 14 - protein, 133 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 15 - protein, 133 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 16 - protein, 133 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 17 - protein, 133 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 18 - protein, 133 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 19 - protein, 133 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 20 - protein, 133 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 21 - protein, 133 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 22 - protein, 133 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 23 - protein, 133 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 24 - protein, 133 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 25 - protein, 133 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 26 - protein, 133 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 27 - protein, 133 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 28 - protein, 133 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLT

SEQ ID NO: 29 - protein, 133 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLT

SEQ ID NO: 30 - protein, 133 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLT

SEQ ID NO: 31 - protein, 133 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLT

SEQ ID NO: 32 - protein, 133 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 33 - protein, 133 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 34 - protein, 133 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLT

SEQ ID NO: 35 - protein, 133 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 36 - protein, 133 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLT

SEQ ID NO: 37 - protein, 133 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLT

SEQ ID NO: 38 - protein, 133 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 39 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 227 aa, synthetic construct
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 227 aa, synthetic construct
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 227 aa, synthetic construct
DKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 43 - protein, 227 aa, synthetic construct
DKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 44 - protein, 229 aa, synthetic construct
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 45 - protein, 229 aa, synthetic construct
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 46 - protein, 229 aa, synthetic construct
ESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 47 - protein, 229 aa, synthetic construct
ESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 48 - protein, 20 aa, synthetic construct
GGGGSGGGGSGGGGSGGGGS

SEQ ID NO: 49 - protein, 36 aa, synthetic construct
AGSGGSGGSGGSPVPSTPPTNSSSTPPTPSPSASGS

SEQ ID NO: 50 - protein, 44 aa, synthetic construct
AGSGGSGGSGGSPVPSTPPTPSPSTPPTPSPSGGSGNSSGSGGS

SEQ ID NO: 51 - protein, 48 aa, synthetic construct
AGSGNSSGSGGSGGSGNSSGSGGSPVPSTPPTPSPSTPPTPSPSASGS

SEQ ID NO: 52 - protein, 24 aa, synthetic construct
AEAAAKEAAAKEAAAKEAAAKAGS

SEQ ID NO: 53 - protein, 25 aa, synthetic construct
GTTPNPPASSSTTGSSTPTNPPAGS

SEQ ID NO: 54 - protein, 37 aa, synthetic construct
AGSPGAGNGGNNGGNPPPPTTTTSSAPATTTTASAGS

SEQ ID NO: 55 - protein, 22 aa, synthetic construct
GGGSAGGGSAGGGSAGGGSAGS

SEQ ID NO: 56 - protein, 380 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 380 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 380 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 380 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 380 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 380 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 380 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 380 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 380 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 380 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 380 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 380 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 380 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 380 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 380 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 380 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 380 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 380 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 380 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 380 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 380 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 380 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 380 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 380 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 380 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 380 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 380 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 115 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 380 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 380 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 380 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 380 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 380 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 380 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 380 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 380 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 380 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 380 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 133 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 134 - protein, 380 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 135 - protein, 380 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 136 - protein, 380 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 137 - protein, 380 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 138 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 139 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 140 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 141 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 142 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 143 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 144 - protein, 380 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 145 - protein, 380 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 146 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 147 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 148 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 149 - protein, 380 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 150 - protein, 380 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 151 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 152 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 153 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 154 - protein, 380 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 155 - protein, 380 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 156 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 157 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 158 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 159 - protein, 380 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 160 - protein, 380 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 161 - protein, 380 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 162 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 163 - protein, 380 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 164 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 165 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 166 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 167 - protein, 380 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 168 - protein, 380 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 169 - protein, 380 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 170 - protein, 380 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 171 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 172 - protein, 380 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 173 - protein, 380 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 174 - protein, 380 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 175 - protein, 380 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 176 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 177 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 178 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 179 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 180 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 181 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 182 - protein, 380 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 183 - protein, 380 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 184 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 185 - protein, 380 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 186 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 187 - protein, 380 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 188 - protein, 380 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 189 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 190 - protein, 380 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 191 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 192 - protein, 380 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 193 - protein, 380 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 194 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 195 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 196 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 197 - protein, 380 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 198 - protein, 380 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 199 - protein, 380 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 200 - protein, 380 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 201 - protein, 380 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 202 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 203 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 204 - protein, 380 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 205 - protein, 380 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 206 - protein, 380 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 207 - protein, 380 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 208 - protein, 382 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 209 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 210 - protein, 382 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 211 - protein, 382 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 212 - protein, 382 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - protein, 382 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 214 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 215 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 216 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 217 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 218 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 219 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 220 - protein, 382 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 221 - protein, 382 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 222 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 223 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 224 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 225 - protein, 382 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 226 - protein, 382 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 227 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 228 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 229 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 230 - protein, 382 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 231 - protein, 382 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 232 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 233 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 234 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 235 - protein, 382 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 236 - protein, 382 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 237 - protein, 382 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 238 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 239 - protein, 382 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 240 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 241 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 242 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 243 - protein, 382 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 244 - protein, 382 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 245 - protein, 382 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 246 - protein, 382 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 247 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 248 - protein, 382 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 249 - protein, 382 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 250 - protein, 382 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 251 - protein, 382 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 252 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 253 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 254 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 255 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 256 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 257 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 258 - protein, 382 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 259 - protein, 382 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 260 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 261 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 262 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 263 - protein, 382 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 264 - protein, 382 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 265 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 266 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 267 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 268 - protein, 382 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 269 - protein, 382 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 270 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 271 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 272 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 273 - protein, 382 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 274 - protein, 382 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 275 - protein, 382 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 276 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 277 - protein, 382 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 278 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 279 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 280 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 281 - protein, 382 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 282 - protein, 382 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 283 - protein, 382 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 284 - protein, 382 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 285 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 286 - protein, 382 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 287 - protein, 382 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 288 - protein, 382 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 289 - protein, 382 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 290 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 291 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 292 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 293 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 294 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 295 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 296 - protein, 382 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 297 - protein, 382 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 298 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 299 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 300 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 301 - protein, 382 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 302 - protein, 382 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 303 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 304 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 305 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 306 - protein, 382 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 307 - protein, 382 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 308 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 309 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 310 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 311 - protein, 382 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 312 - protein, 382 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 313 - protein, 382 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 314 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 315 - protein, 382 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 316 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 317 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 318 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 319 - protein, 382 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 320 - protein, 382 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 321 - protein, 382 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 322 - protein, 382 aa, synthetic construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 323 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 324 - protein, 382 aa, synthetic construct
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 325 - protein, 382 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 326 - protein, 382 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 327 - protein, 382 aa, synthetic construct
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 328 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 329 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 330 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 331 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 332 - protein, 382 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 333 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 334 - protein, 382 aa, synthetic construct
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 335 - protein, 382 aa, synthetic construct
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 336 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 337 - protein, 382 aa, synthetic construct
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 338 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 339 - protein, 382 aa, synthetic construct
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 340 - protein, 382 aa, synthetic construct
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 341 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 342 - protein, 382 aa, synthetic construct
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 343 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 344 - protein, 382 aa, synthetic construct
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 345 - protein, 382 aa, synthetic construct
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 346 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 347 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 348 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 349 - protein, 382 aa, synthetic construct
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 350 - protein, 382 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 351 - protein, 382 aa, synthetic construct
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 352 - protein, 382 aa, synthetic construct
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 353 - protein, 382 aa, synthetic construct
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 354 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 355 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 356 - protein, 382 aa, synthetic construct
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 357 - protein, 382 aa, synthetic construct
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 358 - protein, 382 aa, synthetic construct
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 359 - protein, 382 aa, synthetic construct
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 360 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 361 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 362 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 363 - DNA, 399 bp, synthetic construct
  source 1..399: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 364 - DNA, 399 bp, synthetic construct
  source 1..399: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 365 - DNA, 399 bp, synthetic construct
  source 1..399: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 366 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 367 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 368 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 369 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 370 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 371 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 372 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 373 - DNA, 399 bp, synthetic construct
  source 1..399: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 374 - DNA, 399 bp, synthetic construct
  source 1..399: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 375 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 376 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 377 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 378 - DNA, 399 bp, synthetic construct
  source 1..399: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 379 - DNA, 399 bp, synthetic construct
  source 1..399: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 380 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 381 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 382 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 383 - DNA, 399 bp, synthetic construct
  source 1..399: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 384 - DNA, 399 bp, synthetic construct
  source 1..399: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 385 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 386 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 387 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 388 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 389 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 390 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 391 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 392 - DNA, 399 bp, synthetic construct
  source 1..399: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 393 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 394 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 395 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 396 - DNA, 399 bp, synthetic construct
  source 1..399: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 397 - DNA, 399 bp, synthetic construct
  source 1..399: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 398 - DNA, 399 bp, synthetic construct
  source 1..399: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 399 - DNA, 681 bp, Homo sapiens
  source 1..681: mol_type = genomic DNA
gataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 400 - DNA, 681 bp, synthetic construct
  source 1..681: mol_type = other DNA
gataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 401 - DNA, 681 bp, synthetic construct
  source 1..681: mol_type = other DNA
gataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 402 - DNA, 681 bp, synthetic construct
  source 1..681: mol_type = other DNA
gataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 403 - DNA, 681 bp, synthetic construct
  source 1..681: mol_type = other DNA
gataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 404 - DNA, 687 bp, synthetic construct
  source 1..687: mol_type = other DNA
gaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 405 - DNA, 687 bp, synthetic construct
  source 1..687: mol_type = other DNA
gaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 406 - DNA, 687 bp, synthetic construct
  source 1..687: mol_type = other DNA
gaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 407 - DNA, 687 bp, synthetic construct
  source 1..687: mol_type = other DNA
gaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 408 - DNA, 60 bp, synthetic construct
  source 1..60: mol_type = other DNA
ggtggtggaggatcgggaggtggaggatctggaggaggaggatcgggtggaggaggatcc

SEQ ID NO: 409 - DNA, 108 bp, synthetic construct
  source 1..108: mol_type = other DNA
gcgggctcaggcggctcaggcggaagcggcgggtctccagtgccttcaacccctcccaccaattcaagctccaccccaccgacaccatcaccgtcagcctctggaagc

SEQ ID NO: 410 - DNA, 132 bp, synthetic construct
  source 1..132: mol_type = other DNA
gcaggaagtggcggatccggcggttctggtggttctcctgtgccttctactcctccaactcccagtccgagtaccccacccactccgtcaccttccggtggtagcggtaattctagtggcagtggcggatca

SEQ ID NO: 411 - DNA, 144 bp, synthetic construct
  source 1..144: mol_type = other DNA
gcaggctctgggaattcatccggctctggtggaagtggcgggtcaggtaattcaagcgggtctggcggtagccctgtgccatccacaccgccaactccatctccctctactcctccaacgccaagcccctcagcatccggatct

SEQ ID NO: 412 - DNA, 72 bp, synthetic construct
  source 1..72: mol_type = other DNA
gcggaagcggcggctaaagaggcagccgctaaggaagcagccgctaaggaagcggcagcgaaggctggtagc

SEQ ID NO: 413 - DNA, 75 bp, synthetic construct
  source 1..75: mol_type = other DNA
ggcaccaccccaaatcccccggccagtagctccaccacaggctcatccaccccaacgaaccccccggcaggttca

SEQ ID NO: 414 - DNA, 111 bp, synthetic construct
  source 1..111: mol_type = other DNA
gctgggtcacctggtgctggcaacggtggtaacaacggtggtaatcctcctcccccgactaccacgactagcagcgccccggctacgaccactacggcgtccgcagggtca

SEQ ID NO: 415 - DNA, 66 bp, synthetic construct
  source 1..66: mol_type = other DNA
ggcggcggtagtgccggagggggatctgccggcggtggatcagcgggtggcggctctgcgggaagc

SEQ ID NO: 416 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 417 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 418 - DNA, 1140 bp, synthetic construct
  source 1..1140: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 419 - DNA, 1140 bp, synthetic construct
  source 1..1140: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 420 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 421 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 422 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 423 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 424 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 425 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 426 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 427 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 428 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 429 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 430 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 431 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 432 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 433 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 434 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 435 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 436 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 437 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 438 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 439 - DNA, 1140 bp, synthetic construct
  source 1..1140: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 440 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 441 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 442 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 443 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 444 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 445 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 446 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 447 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 448 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 449 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 450 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 451 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 452 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 453 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 454 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 455 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 456 - DNA, 1140 bp, synthetic construct
  source 1..1140: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 457 - DNA, 1140 bp, synthetic construct
  source 1..1140: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 458 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 459 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 460 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 461 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 462 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 463 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 464 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 465 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 466 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 467 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 468 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 469 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 470 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 471 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 472 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 473 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 474 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 475 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 476 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 477 - DNA, 1140 bp, synthetic construct
  source 1..1140: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 478 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 479 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 480 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 481 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 482 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 483 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 484 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 485 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 486 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 487 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 488 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 489 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 490 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 491 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 492 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 493 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 494 - DNA, 1140 bp, synthetic construct
  source 1..1140: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 495 - DNA, 1140 bp, synthetic construct
  source 1..1140: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 496 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 497 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 498 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 499 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 500 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 501 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 502 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 503 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 504 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 505 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 506 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 507 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 508 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 509 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 510 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 511 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 512 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 513 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 514 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 515 - DNA, 1140 bp, synthetic construct
  source 1..1140: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 516 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 517 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 518 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 519 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 520 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 521 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 522 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 523 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 524 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 525 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 526 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 527 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 528 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 529 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 530 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 531 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 532 - DNA, 1140 bp, synthetic construct
  source 1..1140: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 533 - DNA, 1140 bp, synthetic construct
  source 1..1140: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 534 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 535 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 536 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 537 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 538 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 539 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 540 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 541 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 542 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 543 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 544 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 545 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 546 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 547 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 548 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 549 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 550 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 551 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 552 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 553 - DNA, 1140 bp, synthetic construct
  source 1..1140: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 554 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 555 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 556 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 557 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 558 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 559 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 560 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 561 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 562 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 563 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 564 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 565 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 566 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 567 - DNA, 1140 bp, synthetic construct
  source 1..1140: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 568 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 569 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 570 - DNA, 1146 bp, synthetic construct
  source 1..1146: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 571 - DNA, 1146 bp, synthetic construct
  source 1..1146: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 572 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 573 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 574 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 575 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 576 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 577 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 578 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 579 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 580 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 581 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 582 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 583 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 584 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 585 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 586 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 587 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 588 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 589 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 590 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 591 - DNA, 1146 bp, synthetic construct
  source 1..1146: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 592 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 593 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 594 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 595 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 596 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 597 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 598 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 599 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 600 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 601 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 602 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 603 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 604 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 605 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 606 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 607 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 608 - DNA, 1146 bp, synthetic construct
  source 1..1146: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 609 - DNA, 1146 bp, synthetic construct
  source 1..1146: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 610 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 611 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 612 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 613 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 614 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 615 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 616 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 617 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 618 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 619 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 620 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 621 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 622 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 623 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 624 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 625 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 626 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 627 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 628 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 629 - DNA, 1146 bp, synthetic construct
  source 1..1146: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 630 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 631 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 632 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 633 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 634 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 635 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 636 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 637 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 638 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 639 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 640 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 641 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 642 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 643 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 644 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 645 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 646 - DNA, 1146 bp, synthetic construct
  source 1..1146: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 647 - DNA, 1146 bp, synthetic construct
  source 1..1146: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 648 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 649 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 650 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 651 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 652 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 653 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 654 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 655 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 656 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 657 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 658 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 659 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 660 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 661 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 662 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 663 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 664 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 665 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 666 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 667 - DNA, 1146 bp, synthetic construct
  source 1..1146: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 668 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 669 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 670 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 671 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 672 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 673 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 674 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 675 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 676 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 677 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 678 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 679 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 680 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 681 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 682 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 683 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 684 - DNA, 1146 bp, synthetic construct
  source 1..1146: mol_type = other DNA
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 685 - DNA, 1146 bp, synthetic construct
  source 1..1146: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 686 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 687 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 688 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 689 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 690 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 691 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 692 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 693 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 694 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 695 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 696 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 697 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 698 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 699 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 700 - DNA, 1146 bp, synthetic construct
  source 1..1146: mol_type = other DNA
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 701 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 702 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 703 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 704 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 705 - DNA, 1146 bp, synthetic construct
  source 1..1146: mol_type = other DNA
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 706 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 707 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 708 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 709 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 710 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 711 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 712 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 713 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 714 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 715 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 716 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 717 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 718 - DNA, 1146 bp, synthetic construct
  source 1..1146: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 719 - DNA, 1146 bp, synthetic construct
  source 1..1146: mol_type = other DNA
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 720-999 - skipped (280 entries)

SEQ ID NO: 1000 - protein, 133 aa, synthetic construct
APASSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 1001 - protein, 133 aa, synthetic construct
APASSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 1002 - protein, 133 aa, synthetic construct
APASSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 1003 - protein, 227 aa, synthetic construct
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1004 - protein, 380 aa, synthetic construct
APASSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1005 - protein, 380 aa, synthetic construct
APASSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1006 - protein, 380 aa, synthetic construct
APASSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1007 - protein, 380 aa, synthetic construct
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1008 - protein, 380 aa, synthetic construct
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1009 - protein, 380 aa, synthetic construct
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1010 - DNA, 399 bp, synthetic construct
  source 1..399: mol_type = other DNA
gcccctgcatcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 1011 - DNA, 399 bp, synthetic construct
  source 1..399: mol_type = other DNA
gcccctgcatcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 1012 - DNA, 399 bp, synthetic construct
  source 1..399: mol_type = other DNA
gcccctgcatcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 1013 - DNA, 681 bp, synthetic construct
  source 1..681: mol_type = other DNA
gataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1014 - DNA, 1140 bp, synthetic construct
  source 1..1140: mol_type = other DNA
gcccctgcatcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1015 - DNA, 1140 bp, synthetic construct
  source 1..1140: mol_type = other DNA
gcccctgcatcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1016 - DNA, 1140 bp, synthetic construct
  source 1..1140: mol_type = other DNA
gcccctgcatcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1017 - DNA, 1140 bp, synthetic construct
  source 1..1140: mol_type = other DNA
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1018 - DNA, 1140 bp, synthetic construct
  source 1..1140: mol_type = other DNA
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1019 - DNA, 1140 bp, synthetic construct
  source 1..1140: mol_type = other DNA
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1020-1030 - skipped (11 entries)

SEQ ID NO: 1031 - protein, 133 aa, Homo sapiens [sequence omitted]

SEQ ID NO: 1032 - protein, 133 aa, synthetic construct
  VARIANT 3: note = T or A
  VARIANT 16: note = H, L or N
  VARIANT 28: note = I, T or F
  VARIANT 35: note = K or E
  VARIANT 38: note = R, E, N or Q
  VARIANT 42: note = F, A, K or Q
  VARIANT 68: note = E, Q or N
  VARIANT 69: note = V or A
  VARIANT 74: note = Q or P
  VARIANT 84: note = D or V
  VARIANT 87: note = S or R
  VARIANT 88: note = N, D, L or S
  VARIANT 92: note = I or S
  VARIANT 125: note = C or S
  VARIANT 126: note = Q, K, R or T
APXSSSTKKTQLQLEXLLLDLQMILNGXNNYKNPXLTXMLTXKFYMPKKATELKHLQCLEEELKPLEXXLNLAXSKNFHLRPRXLIXXINVXVLELKGSETTFMCEYADETATIVEFLNRWITFXXSIISTLT

The invention claimed is:

1. A method of conditioning a subject prior to a heart transplant, comprising administering to a subject in need thereof an effective amount of an IL-2 variant, wherein the IL-2 variant comprises the amino acid sequence of SEQ ID NO: 5, thereby conditioning the subject prior to the heart transplant.

2. The method of claim 1, further comprising administering an immunosuppressive agent to the subject.

3. The method of claim 2, wherein the immunosuppressive agent comprises rapamycin.

4. The method of claim 1, wherein the subject is a human or a non-human primate or a mouse.

5. The method of claim 1, wherein the IL-2 variant is fused to an Fc region, thereby forming an IL-2 Fc fusion protein.

6. The method of claim 5, wherein the Fc region comprises an amino acid sequence of SEQ ID NO: 1003.

7. The method of claim 5, wherein the Fc region is fused to the C-terminus of the IL-2 variant.

8. The method of claim 5, wherein the IL-2 Fc fusion protein further comprises a linker.

9. The method of claim 8, wherein the linker comprises (G4S)4 (SEQ ID NO: 48).

10. The method of claim 5, wherein the IL-2 Fc fusion protein comprises an amino acid sequence of SEQ ID NO: 1008.

11. The method of claim 5, wherein the IL-2 Fc fusion protein forms a dimer.

* * * * *